(12) United States Patent
Dundon et al.

(10) Patent No.: US 9,249,420 B2
(45) Date of Patent: Feb. 2, 2016

(54) ISOBUTANOL PRODUCTION USING YEASTS WITH MODIFIED TRANSPORTER EXPRESSION

(75) Inventors: Catherine Asleson Dundon, Englewood, CO (US); Christopher Smith, Englewood, CO (US); Piruz Nahreini, Broomfield, CO (US); Johan Thevelein, Blanden (BE); Sofie Saerens, Meerbeke (BE)

(73) Assignees: VIB VZW, Ghent (BE); KATHOLIEKE UNIVERSITEIT LEUVEN, K.U. LEUVEN R&D, Leuven (BE)

( * ) Notice: Subject to any disclaimer, the term of this patent is extended or adjusted under 35 U.S.C. 154(b) by 0 days.

(21) Appl. No.: 13/701,247

(22) PCT Filed: May 31, 2011

(86) PCT No.: PCT/US2011/038566
§ 371 (c)(1),
(2), (4) Date: Feb. 14, 2013

(87) PCT Pub. No.: WO2011/153144
PCT Pub. Date: Dec. 8, 2011

(65) Prior Publication Data
US 2013/0302868 A1 Nov. 14, 2013

Related U.S. Application Data

(60) Provisional application No. 61/465,803, filed on Mar. 23, 2011.

(30) Foreign Application Priority Data

May 31, 2010 (EP) .................................... 10164511

(51) Int. Cl.
C12P 7/16 (2006.01)
C12N 15/81 (2006.01)
(Continued)

(52) U.S. Cl.
CPC .............. *C12N 15/81* (2013.01); *C07K 14/395* (2013.01); *C12N 1/00* (2013.01); *C12P 7/16* (2013.01); *Y02E 50/10* (2013.01)

(58) Field of Classification Search
None
See application file for complete search history.

(56) References Cited

U.S. PATENT DOCUMENTS

2003/0119013 A1  6/2003  Jiang et al.
2007/0117186 A1  5/2007  Sahara et al.
(Continued)

OTHER PUBLICATIONS

International Search Report, PCT Appl. No. PCT/US11/38566, 3 pages (Sep. 21, 2011).
(Continued)

*Primary Examiner* — Robert Mondesi
*Assistant Examiner* — Richard Ekstrom
(74) *Attorney, Agent, or Firm* — Cooley LLP

(57) ABSTRACT

The present invention relates to recombinant microorganisms comprising an isobutanol producing metabolic pathway and methods of using said recombinant microorganisms to produce isobutanol. In various aspects of the invention, the recombinant microorganisms may comprise one or more modifications resulting in the reduction in the expression and/or activity of an endogenous transporter protein. In various embodiments described herein, the recombinant microorganisms may be microorganisms of the *Saccharomyces* clade, Crabtree-negative yeast microorganisms, Crabtree-positive yeast microorganisms, post-WGD (whole genome duplication) yeast microorganisms, pre-WGD (whole genome duplication) yeast microorganisms, and non-fermenting yeast microorganisms.

19 Claims, 7 Drawing Sheets

(51) Int. Cl.
*C12N 1/00* (2006.01)
*C07K 14/395* (2006.01)

(56) References Cited

U.S. PATENT DOCUMENTS

| | | | |
|---|---|---|---|
| 2009/0047718 A1* | 2/2009 | Blaschek et al. | 435/150 |
| 2009/0068111 A1 | 3/2009 | Muchowski et al. | |
| 2009/0226991 A1 | 9/2009 | Feldman et al. | |
| 2009/0305363 A1* | 12/2009 | Anthony et al. | 435/115 |
| 2010/0120126 A1 | 5/2010 | Hashimoto et al. | |
| 2010/0221801 A1* | 9/2010 | Van Dyk | 435/160 |
| 2011/0053235 A1* | 3/2011 | Festel et al. | 435/160 |
| 2011/0124060 A1* | 5/2011 | Anthony et al. | 435/115 |
| 2011/0244536 A1* | 10/2011 | Nagarajan et al. | 435/146 |

OTHER PUBLICATIONS

Written Opinion of the International Searching Authority, PCT Appl. No. PCT/US11/38566, 7 pages (Sep. 21, 2011).

* cited by examiner

ISOBUTANOL PRODUCTION USING YEASTS WITH MODIFIED TRANSPORTER EXPRESSION

CROSS-REFERENCE TO RELATED APPLICATIONS

This application is a U.S. national stage application of PCT Application No. PCT/US2011/038566, filed May 31, 2011, which claims priority to European Application Serial No. 10164511.7, filed May 31, 2010, and U.S. Provisional Application Ser. No. 61/465,803, filed Mar. 23, 2011, each of which are herein incorporated by reference in their entireties for all purposes.

TECHNICAL FIELD

Recombinant microorganisms and methods of producing such microorganisms are provided. Also provided are methods of producing beneficial metabolites including fuels and chemicals by contacting a suitable substrate with the recombinant microorganisms of the invention and enzymatic preparations therefrom.

DESCRIPTION OF THE TEXT FILE SUBMITTED ELECTRONICALLY

The contents of the text file submitted electronically herewith are incorporated herein by reference in their entirety: A computer readable format copy of the Sequence Listing (filename: GEVO_060_01US_SeqList_ST25.txt, date recorded: Nov. 29, 2012, file size 1,917 kilobytes).

BACKGROUND

The ability of microorganisms to convert sugars to beneficial metabolites including fuels, chemicals, and amino acids has been widely described in the literature in recent years. See, e.g., Alper et al., 2009, Nature Microbiol. Rev. 7: 715-723 and McCourt et al., 2006, Amino Acids 31: 173-210. Recombinant engineering techniques have enabled the creation of microorganisms that express biosynthetic pathways capable of producing a number of useful products, including the commodity chemical, isobutanol.

Isobutanol, also a promising biofuel candidate, has been produced in recombinant microorganisms expressing a heterologous, five-step metabolic pathway (See, e.g., WO/2007/050671 to Donaldson et al., WO/2008/098227 to Liao et al., and WO/2009/103533 to Festel et al.). However, the microorganisms produced to date have fallen short of commercial relevance due to their low performance characteristics, including, for example low productivity, low titer, low yield, and the requirement for oxygen during the fermentation process. Thus, recombinant microorganisms exhibiting increased isobutanol productivity, titers, and/or yields are desirable.

The present inventors have discovered that the production of isobutanol can be improved in existing isobutanol-producing recombinant microorganisms by modifying the expression or activity of one or more transporter proteins. Without being bound to any theory, the present inventors have found that modifying the expression or activity of one or more transporter proteins influences the flux through the isobutanol pathway, and particularly impacts secretion of acetolactate. This is particularly unexpected, as no transporters for acetolactate have been described in yeast and a variety of the transporters described herein have been identified as being involved in the transport of unrelated compounds.

The present invention results from the study of these transporter proteins and shows that the suppression of one or more of these transporter proteins improves the production of isobutanol.

SUMMARY OF THE INVENTION

The present inventors have discovered that reducing the expression and/or activity of one or more transporter proteins in yeast can improve production of the isobutanol.

In a first aspect, the present invention relates to a recombinant microorganism for producing isobutanol, wherein said recombinant microorganism comprises an isobutanol producing metabolic pathway and wherein said recombinant microorganism is (a) engineered to reduce the expression and/or activity of one or more endogenous transporter proteins and/or is (b) substantially free of the expression and/or activity of one or more endogenous transporter proteins.

In various embodiments described herein, one or more of the endogenous transporter proteins is selected from the group consisting of the oligopeptide transporter (OPT) superfamily, the ATP binding cassette (ABC) transporter superfamily, the major facilitator superfamily (MFS), and the amino acid-polyamine-organocation (APC) superfamily. In some embodiments, one or more of the endogenous transporter proteins is a yeast member of the OPT, ABC, MFS or APC superfamilies.

In one embodiment, one or more of the endogenous transporter proteins is a member of the oligopeptide transporter (OPT) superfamily. In some embodiments, the OPT superfamily member is a protein encoded by a gene selected from the group consisting of OPT1, OPT2, and YGL141W, or homologs or variants thereof. In an exemplary embodiment, the OPT superfamily member is the S. cerevisiae protein, Opt1p (SEQ ID NO: 2), or a homolog or variant thereof. In another exemplary embodiment, the OPT superfamily member is the S. cerevisiae protein, Opt2p (SEQ ID NO: 4), or a homolog or variant thereof.

In one embodiment, one or more of the endogenous transporter proteins is a member of the ATP binding cassette (ABC) transporter superfamily. In some embodiments, the ABC superfamily member is a protein encoded by a gene selected from the group consisting of ADP1, ARB1, ATM1, AUS1, BPT1, MDL1, MDL2, NFT1, PDR5, PDR10, PDR11, PDR12, PDR15, PDR18, PXA1, PXA2, RLI1, SNQ2, STE6, VMA8, VMR1, YBT1, YCF1, YOR1, YKR104W, and YOL075C, or homologs or variants thereof. In an exemplary embodiment, the ABC superfamily member is the S. cerevisiae protein Adp1p (SEQ ID NO: 6), or a homolog or variant thereof. In another exemplary embodiment, the ABC superfamily member is the S. cerevisiae protein Pdr12p (SEQ ID NO: 8), or a homolog or variant thereof. In a further embodiment, the expression and/or activity of a transcriptional regulator of Pdr12p is reduced. In an exemplary embodiment, the transcriptional regulator of Pdr12p is the S. cerevisiae protein War1p (SEQ ID NO: 18), or a homolog or variant thereof.

In one embodiment, one or more of the endogenous transporter proteins is a member of the major facilitator (MFS) superfamily. In some embodiments, the MFS superfamily member is a protein encoded by a gene selected from the group consisting of AQR1, ATR1, AZR1, DTR1, ENB1, FLR1, HOL1, PDR8, QDR1, QDR2, QDR3, SEO1, SGE1, SSU1, THI7, TPN1, VBA5, and YIL166C, or homologs or variants thereof. In an exemplary embodiment, the MFS superfamily member is the S. cerevisiae protein Aqr1p (SEQ ID NO: 10), or a homolog or variant thereof. In another exemplary embodiment, the MFS superfamily member is the *S. cerevisiae* protein Qdr1p (SEQ ID NO: 12), or a homolog or variant thereof. In yet another exemplary embodiment, the MFS superfamily member is the *S. cerevisiae* protein Qdr2p (SEQ ID NO: 14), or a homolog or variant thereof.

In one embodiment, one or more of the endogenous transporter proteins is a member of the amino acid-polyamine-organocation (APC) superfamily. In some embodiments, the APC superfamily member is a protein encoded by a gene selected from the group consisting of AGP1, AGP2, AGP3, ALP1, BAP2, BAP3, BIO5, CAN1, DIP5, GAP1, GNP1, HIP1, HNM1, LYP1, MMP1, PUT4, SAM3, SSY1, TAT1, TAT2, TPO1, TPO2, TPO3, TPO4, TPO5, and UGA4, or homologs or variants thereof. In an exemplary embodiment, the APC superfamily member is the *S. cerevisiae* protein, Dip5p (SEQ ID NO: 16), or a homolog or variant thereof.

In one embodiment, the invention is directed to a recombinant microorganism for producing isobutanol, wherein said recombinant microorganism comprises an isobutanol producing metabolic pathway and wherein said recombinant microorganism is engineered to reduce the expression or activity of an endogenous transporter protein selected from at least two of the following: (i) an OPT superfamily member; (ii) an ABC superfamily member; (iii) a MFS superfamily member; and/or (iv) an APC superfamily member. In another embodiment, the invention is directed to a recombinant microorganism for producing isobutanol, wherein said recombinant microorganism comprises an isobutanol producing metabolic pathway and wherein said recombinant microorganism is engineered to reduce the expression or activity of an endogenous transporter protein selected from at least three of the following: (i) an OPT superfamily member; (ii) an ABC superfamily member; (iii) a MFS superfamily member; and/or (iv) an APC superfamily member. In yet another embodiment, the invention is directed to a recombinant microorganism for producing isobutanol, wherein said recombinant microorganism comprises an isobutanol producing metabolic pathway and wherein said recombinant microorganism is engineered to reduce the expression or activity of an endogenous transporter protein selected from all four of the following: (i) an OPT superfamily member; (ii) an ABC superfamily member; (iii) a MFS superfamily member; and/or (iv) an APC superfamily member.

In various embodiments described herein, the recombinant microorganism comprises an isobutanol producing metabolic pathway. In one embodiment, the isobutanol producing metabolic pathway comprises at least one exogenous gene encoding a polypeptide that catalyzes a step in the conversion of pyruvate to isobutanol. In another embodiment, the isobutanol producing metabolic pathway comprises at least two exogenous genes encoding polypeptides that catalyze steps in the conversion of pyruvate to isobutanol. In yet another embodiment, the isobutanol producing metabolic pathway comprises at least three exogenous genes encoding polypeptides that catalyze steps in the conversion of pyruvate to isobutanol. In yet another embodiment, the isobutanol producing metabolic pathway comprises at least four exogenous genes encoding polypeptides that catalyze steps in the conversion of pyruvate to isobutanol. In yet another embodiment, the isobutanol producing metabolic pathway comprises at least five exogenous genes encoding polypeptides that catalyze steps in the conversion of pyruvate to isobutanol. In yet another embodiment, all of the isobutanol producing metabolic pathway steps in the conversion of pyruvate to isobutanol are converted by exogenously encoded enzymes.

In one embodiment, one or more of the isobutanol pathway genes encodes an enzyme that is localized to the cytosol. In one embodiment, the recombinant microorganisms comprise an isobutanol producing metabolic pathway with at least one isobutanol pathway enzyme localized in the cytosol. In another embodiment, the recombinant microorganisms comprise an isobutanol producing metabolic pathway with at least two isobutanol pathway enzymes localized in the cytosol. In yet another embodiment, the recombinant microorganisms comprise an isobutanol producing metabolic pathway with at least three isobutanol pathway enzymes localized in the cytosol. In yet another embodiment, the recombinant microorganisms comprise an isobutanol producing metabolic pathway with at least four isobutanol pathway enzymes localized in the cytosol. In an exemplary embodiment, the recombinant microorganisms comprise an isobutanol producing metabolic pathway with five isobutanol pathway enzymes localized in the cytosol. In yet another exemplary embodiment, the recombinant microorganisms comprise an isobutanol producing metabolic pathway with all isobutanol pathway enzymes localized in the cytosol.

In various embodiments described herein, the isobutanol pathway genes genes may encode enzyme(s) selected from the group consisting of acetolactate synthase (ALS), ketol-acid reductoisomerase (KARI), dihydroxyacid dehydratase (DHAD), 2-keto-acid decarboxylase, e.g., keto-isovalerate decarboxylase (KIVD), and alcohol dehydrogenase (ADH).

In various embodiments described herein, the recombinant microorganisms of the invention that comprise an isobutanol producing metabolic pathway may be further engineered to reduce or eliminate the expression or activity of one or more enzymes selected from a pyruvate decarboxylase (PDC), a glycerol-3-phosphate dehydrogenase (GPD), a 3-keto acid reductase (3-KAR), or an aldehyde dehydrogenase (ALDH).

In various embodiments described herein, the recombinant microorganisms may be recombinant yeast microorganisms. In some embodiments, the recombinant yeast microorganisms may be members of the *Saccharomyces* clade, *Saccharomyces sensu stricto* microorganisms, Crabtree-negative yeast microorganisms, Crabtree-positive yeast microorganisms, post-WGD (whole genome duplication) yeast microorganisms, pre-WGD (whole genome duplication) yeast microorganisms, and non-fermenting yeast microorganisms.

In some embodiments, the recombinant microorganisms may be yeast recombinant microorganisms of the *Saccharomyces* clade.

In some embodiments, the recombinant microorganisms may be *Saccharomyces sensu stricto* microorganisms. In one embodiment, the *Saccharomyces sensu stricto* is selected from the group consisting of *S. cerevisiae, S. kudriavzevii, S. mikatae, S. bayanus, S. uvarum, S. carocanis* and hybrids thereof.

In some embodiments, the recombinant microorganisms may be Crabtree-negative recombinant yeast microorganisms. In one embodiment, the Crabtree-negative yeast microorganism is classified into a genera selected from the group consisting of *Saccharomyces, Kluyveromyces, Pichia, Issatchenkia, Hansenula,* or *Candida*. In additional embodiments, the Crabtree-negative yeast microorganism is selected from *Saccharomyces kluyveri, Kluyveromyces lactic, Kluyveromyces marxianus, Pichia anomala, Pichia stipitis, Hansenula anomala, Candida utilis* and *Kluyveromyces waltii*.

In some embodiments, the recombinant microorganisms may be Crabtree-positive recombinant yeast microorganisms. In one embodiment, the Crabtree-positive yeast microorganism is classified into a genera selected from the group consisting of *Saccharomyces, Kluyveromyces, Zygosaccharomyces, Debaryomyces, Candida, Pichia* and *Schizosaccharomyces*. In additional embodiments, the Crabtree-positive yeast microorganism is selected from the group consisting of *Saccharomyces cerevisiae, Saccharomyces uvarum, Saccharomyces bayanus, Saccharomyces paradoxus, Saccharomyces castelli, Kluyveromyces thermotolerans, Candida glabrata, Z. bailli, Z. rouxii, Debaryomyces hansenii, Pichia pastorius, Schizosaccharomyces pombe,* and *Saccharomyces uvarum*.

In some embodiments, the recombinant microorganisms may be post-WGD (whole genome duplication) yeast recombinant microorganisms. In one embodiment, the post-WGD yeast recombinant microorganism is classified into a genera selected from the group consisting of *Saccharomyces* or *Candida*. In additional embodiments, the post-WGD yeast is selected from the group consisting of *Saccharomyces cerevisiae, Saccharomyces uvarum, Saccharomyces bayanus, Saccharomyces paradoxus, Saccharomyces castelli,* and *Candida glabrata*.

In some embodiments, the recombinant microorganisms may be pre-WGD (whole genome duplication) yeast recombinant microorganisms. In one embodiment, the pre-WGD yeast recombinant microorganism is classified into a genera selected from the group consisting of *Saccharomyces, Kluyveromyces, Candida, Pichia, Issatchenkia, Debaryomyces, Hansenula, Pachysolen, Yarrowia* and *Schizosaccharomyces*. In additional embodiments, the pre-WGD yeast is selected from the group consisting of *Saccharomyces kluyveri, Kluyveromyces thermotolerans, Kluyveromyces marxianus, Kluyveromyces waltii, Kluyveromyces lactis, Candida tropicalis, Pichia pastoris, Pichia anomala, Pichia stipitis, Issatchenkia orientalis, Issatchenkia occidentalis, Debaryomyces hansenii, Hansenula anomala, Pachysolen tannophilis, Yarrowia lipolytica,* and *Schizosaccharomyces pombe*.

In some embodiments, the recombinant microorganisms may be microorganisms that are non-fermenting yeast microorganisms, including, but not limited to those, classified into a genera selected from the group consisting of *Tricosporon, Rhodotorula, Myxozyma,* or *Candida*. In a specific embodiment, the non-fermenting yeast is *C. xestobii*.

In another aspect, the present invention provides methods of producing isobutanol using a recombinant microorganism as described herein. In one embodiment, the method includes cultivating the recombinant microorganism in a culture medium containing a feedstock providing the carbon source until a recoverable quantity of isobutanol is produced and optionally, recovering the isobutanol. In one embodiment, the microorganism produces isobutanol from a carbon source at a yield of at least about 5 percent theoretical. In another embodiment, the microorganism produces isobutanol at a yield of at least about 10 percent, at least about 15 percent, about least about 20 percent, at least about 25 percent, at least about 30 percent, at least about 35 percent, at least about 40 percent, at least about 45 percent, at least about 50 percent, at least about 55 percent, at least about 60 percent, at least about 65 percent, at least about 70 percent, at least about 75 percent, at least about 80 percent, at least about 85 percent, at least about 90 percent, at least about 95 percent, or at least about 97.5 percent theoretical.

In one embodiment, the recombinant microorganism is grown under aerobic conditions. In another embodiment, the recombinant microorganism is grown under microaerobic conditions. In yet another embodiment, the recombinant microorganism is grown under anaerobic conditions.

BRIEF DESCRIPTION OF DRAWINGS

Illustrative embodiments of the invention are illustrated in the drawings, in which.

DETAILED DESCRIPTION

Figure 1:
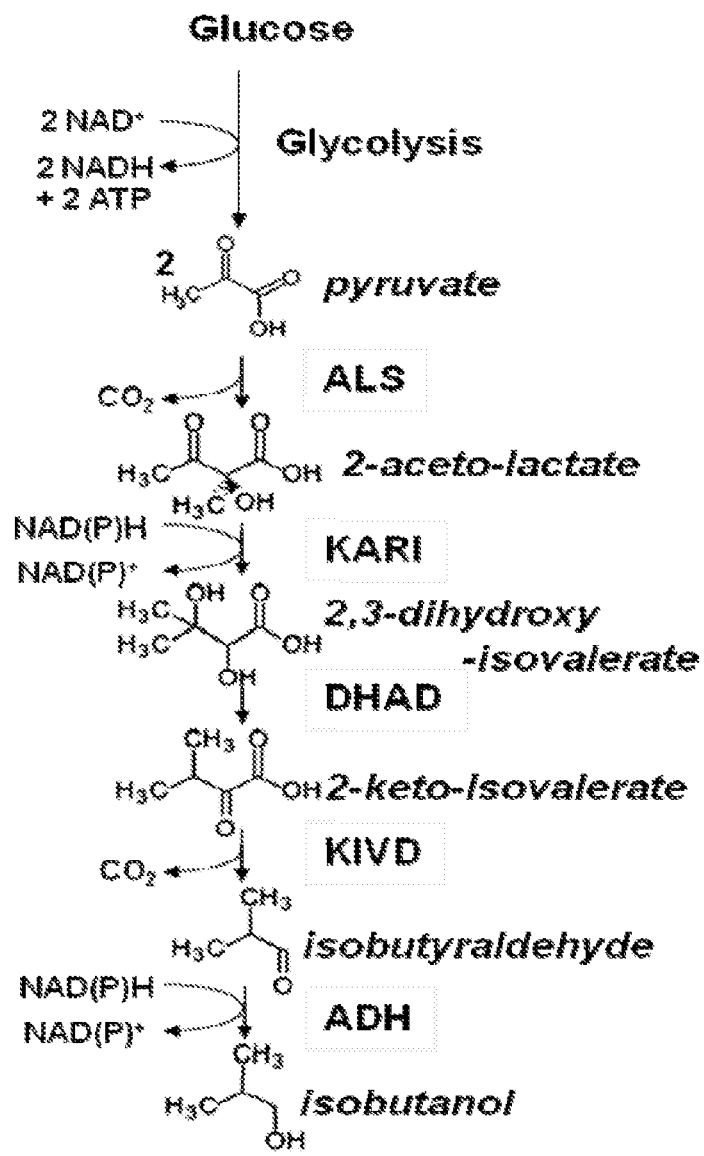
FIG. 1 illustrates an exemplary embodiment of an isobutanol pathway.

As used herein and in the appended claims, the singular forms "a," "an," and "the" include plural referents unless the context clearly dictates otherwise. Thus, for example, reference to "a polynucleotide" includes a plurality of such polynucleotides and reference to "the microorganism" includes reference to one or more microorganisms, and so forth.

Unless defined otherwise, all technical and scientific terms used herein have the same meaning as commonly understood to one of ordinary skill in the art to which this disclosure belongs. Although methods and materials similar or equivalent to those described herein can be used in the practice of the disclosed methods and compositions, the exemplary methods, devices and materials are described herein.

Any publications discussed above and throughout the text are provided solely for their disclosure prior to the filing date of the present application. Nothing herein is to be construed as an admission that the inventors are not entitled to antedate such disclosure by virtue of prior disclosure.

The term "microorganism" includes prokaryotic and eukaryotic microbial species from the Domains Archaea, Bacteria and Eucarya, the latter including yeast and filamentous fungi, protozoa, algae, or higher Protista. The terms "microbial cells" and "microbes" are used interchangeably with the term microorganism.

The term "genus" is defined as a taxonomic group of related species according to the Taxonomic Outline of Bacteria and Archaea (Garrity, G. M., Lilburn, T. G., Cole, J. R., Harrison, S. H., Euzeby, J., and Tindall, B. J. (2007) The Taxonomic Outline of Bacteria and Archaea. TOBA Release 7.7, March 2007. Michigan State University Board of Trustees. [http://www.taxonomicoutline.org/]).

The term "species" is defined as a collection of closely related organisms with greater than 97% 16S ribosomal RNA sequence homology and greater than 70% genomic hybridization and sufficiently different from all other organisms so as to be recognized as a distinct unit.

The terms "recombinant microorganism," "modified microorganism," and "recombinant host cell" are used interchangeably herein and refer to microorganisms that have been genetically modified to express or to overexpress endogenous polynucleotides, to express heterologous polynucleotides, such as those included in a vector, in an integration construct, or which have an alteration in expression of an endogenous gene. By "alteration" it is meant that the expression of the gene, or level of a RNA molecule or equivalent RNA molecules encoding one or more polypeptides or polypeptide subunits, or activity of one or more polypeptides or polypeptide subunits is up regulated or down regulated, such that expression, level, or activity is greater than or less than that observed in the absence of the alteration. For example, the term "alter" can mean "inhibit," but the use of the word "alter" is not limited to this definition. It is understood that the terms "recombinant microorganism" and "recombinant host cell" refer not only to the particular recombinant microorganism but to the progeny or potential progeny of such a microorganism. Because certain modifications may occur in succeeding generations due to either mutation or environmental influences, such progeny may not, in fact, be identical to the parent cell, but are still included within the scope of the term as used herein.

The term "expression" with respect to a gene sequence refers to transcription of the gene and, as appropriate, translation of the resulting mRNA transcript to a protein. Thus, as will be clear from the context, expression of a protein results from transcription and translation of the open reading frame sequence. The level of expression of a desired product in a host cell may be determined on the basis of either the amount of corresponding mRNA that is present in the cell, or the amount of the desired product encoded by the selected sequence. For example, mRNA transcribed from a selected sequence can be quantitated by qRT-PCR or by Northern hybridization (see Sambrook et al., Molecular Cloning: A Laboratory Manual, Cold Spring Harbor Laboratory Press (1989)). Protein encoded by a selected sequence can be quantitated by various methods, e.g., by ELISA, by assaying for the biological activity of the protein, or by employing assays that are independent of such activity, such as western blotting or radioimmunoassay, using antibodies that recognize and bind the protein. See Sambrook et al., 1989, supra.

The term "overexpression" refers to an elevated level (e.g., aberrant level) of mRNAs encoding for a protein(s), and/or to elevated levels of protein(s) in cells as compared to similar corresponding unmodified cells expressing basal levels of mRNAs or having basal levels of proteins. In particular embodiments mRNA(s) or protein(s) may be overexpressed by at least 2-fold, 3-fold, 4-fold, 5-fold, 6-fold, 8-fold, 10-fold, 12-fold, 15-fold or more in microorganisms engineered to exhibit increased gene mRNA, protein, and/or activity.

As used herein and as would be understood by one of ordinary skill in the art, "reduced activity and/or expression" of a protein such as an enzyme can mean either a reduced specific catalytic activity of the protein (e.g. reduced activity) and/or decreased concentrations of the protein in the cell (e.g. reduced expression).

The term "wild-type microorganism" describes a cell that occurs in nature, i.e. a cell that has not been genetically modified. A wild-type microorganism can be genetically modified to express or overexpress a first target enzyme. This microorganism can act as a parental microorganism in the generation of a microorganism modified to express or overexpress a second target enzyme. In turn, the microorganism modified to express or overexpress a first and a second target enzyme can be modified to express or overexpress a third target enzyme.

Accordingly, a "parental microorganism" functions as a reference cell for successive genetic modification events. Each modification event can be accomplished by introducing a nucleic acid molecule in to the reference cell. The introduction facilitates the expression or overexpression of a target enzyme. It is understood that the term "facilitates" encompasses the activation of endogenous polynucleotides encoding a target enzyme through genetic modification of e.g., a promoter sequence in a parental microorganism. It is further understood that the term "facilitates" encompasses the introduction of heterologous polynucleotides encoding a target enzyme in to a parental microorganism The term "engineer" refers to any manipulation of a microorganism that results in a detectable change in the microorganism, wherein the manipulation includes but is not limited to inserting a polynucleotide and/or polypeptide heterologous to the microorganism and mutating a polynucleotide and/or polypeptide native to the microorganism.

The term "mutation" as used herein indicates any modification of a nucleic acid and/or polypeptide which results in an altered nucleic acid or polypeptide. Mutations include, for example, point mutations, deletions, or insertions of single or multiple residues in a polynucleotide, which includes alterations arising within a protein-encoding region of a gene as well as alterations in regions outside of a protein-encoding sequence, such as, but not limited to, regulatory or promoter sequences. A genetic alteration may be a mutation of any type. For instance, the mutation may constitute a point mutation, a frame-shift mutation, a nonsense mutation, an insertion, or a deletion of part or all of a gene. In addition, in some embodiments of the modified microorganism, a portion of the microorganism genome has been replaced with a heterologous polynucleotide. In some embodiments, the mutations are naturally-occurring. In other embodiments, the mutations are identified and/or enriched through artificial selection pressure. In still other embodiments, the mutations in the microorganism genome are the result of genetic engineering.

The term "biosynthetic pathway", also referred to as "metabolic pathway", refers to a set of anabolic or catabolic biochemical reactions for converting one chemical species into another. Gene products belong to the same "metabolic pathway" if they, in parallel or in series, act on the same substrate, produce the same product, or act on or produce a metabolic intermediate (i.e., metabolite) between the same substrate and metabolite end product.

As used herein, the term "isobutanol producing metabolic pathway" refers to an enzyme pathway which produces isobutanol from pyruvate.

The term "exogenous" as used herein with reference to various molecules, e.g., polynucleotides, polypeptides, enzymes, etc., refers to molecules that are not normally or naturally found in and/or produced by a given yeast, bacterium, organism, microorganism, or cell in nature.

On the other hand, the term "endogenous" or "native" as used herein with reference to various molecules, e.g., polynucleotides, polypeptides, enzymes, etc., refers to molecules that are normally or naturally found in and/or produced by a given yeast, bacterium, organism, microorganism, or cell in nature.

The term "heterologous" as used herein in the context of a modified host cell refers to various molecules, e.g., polynucleotides, polypeptides, enzymes, etc., wherein at least one of the following is true: (a) the molecule(s) is/are foreign ("exogenous") to (i.e., not naturally found in) the host cell; (b) the molecule(s) is/are naturally found in (e.g., is "endogenous to") a given host microorganism or host cell but is either produced in an unnatural location or in an unnatural amount in the cell; and/or (c) the molecule(s) differ(s) in nucleotide or amino acid sequence from the endogenous nucleotide or amino acid sequence(s) such that the molecule differing in nucleotide or amino acid sequence from the endogenous nucleotide or amino acid as found endogenously is produced in an unnatural (e.g., greater than naturally found) amount in the cell.

The term "feedstock" is defined as a raw material or mixture of raw materials supplied to a microorganism or fermentation process from which other products can be made. For example, a carbon source, such as biomass or the carbon compounds derived from biomass are a feedstock for a microorganism that produces a biofuel in a fermentation process. However, a feedstock may contain nutrients other than a carbon source.

The term "substrate" or "suitable substrate" refers to any substance or compound that is converted or meant to be converted into another compound by the action of an enzyme. The term includes not only a single compound, but also combinations of compounds, such as solutions, mixtures and other materials which contain at least one substrate, or derivatives thereof. Further, the term "substrate" encompasses not only compounds that provide a carbon source suitable for use as a starting material, such as any biomass derived sugar, but also intermediate and end product metabolites used in a pathway associated with a recombinant microorganism as described herein.

The term "fermentation" or "fermentation process" is defined as a process in which a microorganism is cultivated in a culture medium containing raw materials, such as feedstock and nutrients, wherein the microorganism converts raw materials, such as a feedstock, into products.

The term "volumetric productivity" or "production rate" is defined as the amount of product formed per volume of medium per unit of time. Volumetric productivity is reported in gram per liter per hour (g/L/h).

The term "specific productivity" or "specific production rate" is defined as the amount of product formed per volume of medium per unit of time per amount of cells. Specific productivity is reported in gram or milligram per liter per hour per OD (g/L/h/OD).

The term "yield" is defined as the amount of product obtained per unit weight of raw material and may be expressed as g product per g substrate (g/g). Yield may be expressed as a percentage of the theoretical yield. "Theoretical yield" is defined as the maximum amount of product that can be generated per a given amount of substrate as dictated by the stoichiometry of the metabolic pathway used to make the product. For example, the theoretical yield for one typical conversion of glucose to isobutanol is 0.41 g/g. As such, a yield of isobutanol from glucose of 0.39 g/g would be expressed as 95% of theoretical or 95% theoretical yield.

The term "titer" is defined as the strength of a solution or the concentration of a substance in solution. For example, the titer of a biofuel in a fermentation broth is described as g of biofuel in solution per liter of fermentation broth (g/L).

"Aerobic conditions" are defined as conditions under which the oxygen concentration in the fermentation medium is sufficiently high for an aerobic or facultative anaerobic microorganism to use as a terminal electron acceptor.

In contrast, "anaerobic conditions" are defined as conditions under which the oxygen concentration in the fermentation medium is too low for the microorganism to use as a terminal electron acceptor. Anaerobic conditions may be achieved by sparging a fermentation medium with an inert gas such as nitrogen until oxygen is no longer available to the microorganism as a terminal electron acceptor. Alternatively, anaerobic conditions may be achieved by the microorganism consuming the available oxygen of the fermentation until oxygen is unavailable to the microorganism as a terminal electron acceptor. Methods for the production of isobutanol under anaerobic conditions are described in commonly owned and co-pending publication, US 2010/0143997, the disclosures of which are herein incorporated by reference in its entirety for all purposes.

"Aerobic metabolism" refers to a biochemical process in which oxygen is used as a terminal electron acceptor to make energy, typically in the form of ATP, from carbohydrates. Aerobic metabolism occurs e.g. via glycolysis and the TCA cycle, wherein a single glucose molecule is metabolized completely into carbon dioxide in the presence of oxygen.

In contrast, "anaerobic metabolism" refers to a biochemical process in which oxygen is not the final acceptor of electrons contained in NADH. Anaerobic metabolism can be divided into anaerobic respiration, in which compounds other than oxygen serve as the terminal electron acceptor, and substrate level phosphorylation, in which the electrons from NADH are utilized to generate a reduced product via a "fermentative pathway."

In "fermentative pathways", NAD(P)H donates its electrons to a molecule produced by the same metabolic pathway that produced the electrons carried in NAD(P)H. For example, in one of the fermentative pathways of certain yeast strains, NAD(P)H generated through glycolysis transfers its electrons to pyruvate, yielding ethanol. Fermentative pathways are usually active under anaerobic conditions but may also occur under aerobic conditions, under conditions where NADH is not fully oxidized via the respiratory chain. For example, above certain glucose concentrations, Crabtree positive yeasts produce large amounts of ethanol under aerobic conditions.

The term "byproduct" or "by-product" means an undesired product related to the production of an amino acid, amino acid precursor, chemical, chemical precursor, biofuel, or biofuel precursor.

The term "substantially free" when used in reference to the presence or absence of a protein activity (a transporter protein activity, 3-KAR enzymatic activity, ALDH enzymatic activity, PDC enzymatic activity, GPD enzymatic activity, etc.) means the level of the protein is substantially less than that of the same protein in the wild-type host, wherein less than about 50% of the wild-type level is preferred and less than about 30% is more preferred. The activity may be less than about 20%, less than about 10%, less than about 5%, or less than about 1% of wild-type activity. Microorganisms which are "substantially free" of a particular protein activity (a transporter protein activity, 3-KAR enzymatic activity, ALDH enzymatic activity, PDC enzymatic activity, GPD enzymatic activity, etc.) may be created through recombinant means or identified in nature.

The term "non-fermenting yeast" is a yeast species that fails to demonstrate an anaerobic metabolism in which the electrons from NADH are utilized to generate a reduced product via a fermentative pathway such as the production of ethanol and $CO_2$ from glucose. Non-fermentative yeast can be identified by the "Durham Tube Test" (J. A. Barnett, R. W. Payne, and D. Yarrow. 2000. Yeasts Characteristics and Identification. $3^{rd}$ edition. p. 28-29. Cambridge University Press, Cambridge, UK) or by monitoring the production of fermentation productions such as ethanol and $CO_2$.

The term "polynucleotide" is used herein interchangeably with the term "nucleic acid" and refers to an organic polymer composed of two or more monomers including nucleotides, nucleosides or analogs thereof, including but not limited to single stranded or double stranded, sense or antisense deoxyribonucleic acid (DNA) of any length and, where appropriate, single stranded or double stranded, sense or antisense ribonucleic acid (RNA) of any length, including siRNA. The term "nucleotide" refers to any of several compounds that consist of a ribose or deoxyribose sugar joined to a purine or a pyrimidine base and to a phosphate group, and that are the basic structural units of nucleic acids. The term "nucleoside" refers to a compound (as guanosine or adenosine) that consists of a purine or pyrimidine base combined with deoxyribose or ribose and is found especially in nucleic acids. The term "nucleotide analog" or "nucleoside analog" refers, respectively, to a nucleotide or nucleoside in which one or more individual atoms have been replaced with a different atom or with a different functional group. Accordingly, the term polynucleotide includes nucleic acids of any length, DNA, RNA, analogs and fragments thereof. A polynucleotide of three or more nucleotides is also called nucleotidic oligomer or oligonucleotide.

It is understood that the polynucleotides described herein include "genes" and that the nucleic acid molecules described herein include "vectors" or "plasmids." Accordingly, the term "gene", also called a "structural gene" refers to a polynucleotide that codes for a particular sequence of amino acids, which comprise all or part of one or more proteins or enzymes, and may include regulatory (non-transcribed) DNA sequences, such as promoter sequences, which determine for example the conditions under which the gene is expressed. The transcribed region of the gene may include untranslated regions, including introns, 5'-untranslated region (UTR), and 3'-UTR, as well as the coding sequence.

The term "operon" refers to two or more genes which are transcribed as a single transcriptional unit from a common promoter. In some embodiments, the genes comprising the operon are contiguous genes. It is understood that transcription of an entire operon can be modified (i.e., increased, decreased, or eliminated) by modifying the common promoter. Alternatively, any gene or combination of genes in an operon can be modified to alter the function or activity of the encoded polypeptide. The modification can result in an increase in the activity of the encoded polypeptide. Further, the modification can impart new activities on the encoded polypeptide. Exemplary new activities include the use of alternative substrates and/or the ability to function in alternative environmental conditions.

A "vector" is any means by which a nucleic acid can be propagated and/or transferred between organisms, cells, or cellular components. Vectors include viruses, bacteriophage, pro-viruses, plasmids, phagemids, transposons, and artificial chromosomes such as YACs (yeast artificial chromosomes), BACs (bacterial artificial chromosomes), and PLACs (plant artificial chromosomes), and the like, that are "episomes," that is, that replicate autonomously or can integrate into a chromosome of a host cell. A vector can also be a naked RNA polynucleotide, a naked DNA polynucleotide, a polynucleotide composed of both DNA and RNA within the same strand, a poly-lysine-conjugated DNA or RNA, a peptide-conjugated DNA or RNA, a liposome-conjugated DNA, or the like, that are not episomal in nature, or it can be an organism which comprises one or more of the above polynucleotide constructs such as an *agrobacterium* or a bacterium.

"Transformation" refers to the process by which a vector is introduced into a host cell. Transformation (or transduction, or transfection), can be achieved by any one of a number of means including chemical transformation (e.g. lithium acetate transformation), electroporation, microinjection, biolistics (or particle bombardment-mediated delivery), or *agrobacterium* mediated transformation.

The term "enzyme" as used herein refers to any substance that catalyzes or promotes one or more chemical or biochemical reactions, which usually includes enzymes totally or partially composed of a polypeptide, but can include enzymes composed of a different molecule including polynucleotides.

The term "protein," "peptide," or "polypeptide" as used herein indicates an organic polymer composed of two or more amino acidic monomers and/or analogs thereof. As used herein, the term "amino acid" or "amino acidic monomer" refers to any natural and/or synthetic amino acids including glycine and both D or L optical isomers. The term "amino acid analog" refers to an amino acid in which one or more individual atoms have been replaced, either with a different atom, or with a different functional group. Accordingly, the term polypeptide includes amino acidic polymer of any length including full length proteins, and peptides as well as analogs and fragments thereof. A polypeptide of three or more amino acids is also called a protein oligomer or oligopeptide The term "homolog," used with respect to an original polynucleotide or polypeptide of a first family or species, refers to distinct polynucleotides or polypeptides of a second family or species which are determined by functional, structural or genomic analyses to be a polynucleotide or polypeptide of the second family or species which corresponds to the original polynucleotide or polypeptide of the first family or species. Most often, homologs will have functional, structural or genomic similarities. Techniques are known by which homologs of a polynucleotide or polypeptide can readily be cloned using genetic probes and PCR. Identity of cloned sequences as homolog can be confirmed using functional assays and/or by genomic mapping of the genes.

A polypeptide has "homology" or is "homologous" to a second polypeptide if the amino acid sequence encoded by a gene has a similar amino acid sequence to that of the second gene. Alternatively, a polypeptide has homology to a second polypeptide if the two polypeptides have "similar" amino acid sequences. (Thus, the terms "homologous polypeptides" or "homologous proteins" are defined to mean that the two polypeptides have similar amino acid sequences).

The term "analog" or "analogous" refers to polynucleotide or polypeptide sequences that are related to one another in function only and are not from common descent or do not share a common ancestral sequence. Analogs may differ in sequence but may share a similar structure, due to convergent evolution. For example, two enzymes are analogs or analogous if the enzymes catalyze the same reaction of conversion of a substrate to a product, are unrelated in sequence, and irrespective of whether the two enzymes are related in structure.

Isobutanol Producing Recombinant Microorganisms

Yeast cells convert sugars to produce pyruvate, which is then utilized in a number of pathways of cellular metabolism. In recent years, yeast cells have been engineered to produce a number of desirable products via pyruvate-driven biosynthetic pathways, including isobutanol, an important commodity chemical and biofuel candidate (See, e.g., commonly owned and co-pending patent publications, US 2009/0226991, US 2010/0143997, US 2011/0020889, US 2011/0076733, and WO 2010/075504).

As described herein, the present invention relates to recombinant microorganisms for producing isobutanol, wherein said recombinant microorganisms comprise an isobutanol producing metabolic pathway. In one embodiment, the isobutanol producing metabolic pathway to convert pyruvate to isobutanol can be comprised of the following reactions:
1. 2 pyruvate→acetolactate+$CO_2$
2. acetolactate+NAD(P)H→2,3-dihydroxyisovalerate+NAD(P)$^+$
3. 2,3-dihydroxyisovalerate→alpha-ketoisovalerate
4. alpha-ketoisovalerate→isobutyraldehyde+$CO_2$
5. isobutyraldehyde+NAD(P)H→isobutanol+NADP In one embodiment, these reactions are carried out by the enzymes 1) Acetolactate synthase (ALS), 2) Ketol-acid reductoisomerase (KARI), 3) Dihydroxyacid dehydratase (DHAD), 4) 2-keto-acid decarboxylase, e.g., Keto-isovalerate decarboxylase (KIVD), and 5) an Alcohol dehydrogenase (ADH) (FIG. 1). In some embodiments, the recombinant microorganism may be engineered to overexpress one or more of these enzymes. In an exemplary embodiment, the recombinant microorganism is engineered to overexpress all of these enzymes.

Alternative pathways for the production of isobutanol in yeast have been described in WO/2007/050671 and in Dickinson et al., 1998, *J Biol Chem* 273:25751-6. These and other isobutanol producing metabolic pathways are within the scope of the present invention. In one embodiment, the isobutanol producing metabolic pathway comprises five substrate to product reactions. In another embodiment, the isobutanol producing metabolic pathway comprises six substrate to product reactions. In yet another embodiment, the isobutanol producing metabolic pathway comprises seven substrate to product reactions.

In various embodiments described herein, the recombinant microorganism comprises an isobutanol producing metabolic pathway. In one embodiment, the isobutanol producing metabolic pathway comprises at least one exogenous gene encoding a polypeptide that catalyzes a step in the conversion of pyruvate to isobutanol. In another embodiment, the isobutanol producing metabolic pathway comprises at least two exogenous genes encoding polypeptides that catalyze steps in the conversion of pyruvate to isobutanol. In yet another embodiment, the isobutanol producing metabolic pathway comprises at least three exogenous genes encoding polypeptides that catalyze steps in the conversion of pyruvate to isobutanol. In yet another embodiment, the isobutanol producing metabolic pathway comprises at least four exogenous genes encoding polypeptides that catalyze steps in the conversion of pyruvate to isobutanol. In yet another embodiment, the isobutanol producing metabolic pathway comprises at least five exogenous genes encoding polypeptides that catalyze steps in the conversion of pyruvate to isobutanol. In yet another embodiment, all of the isobutanol producing metabolic pathway steps in the conversion of pyruvate to isobutanol are converted by exogenously encoded enzymes.

In one embodiment, one or more of the isobutanol pathway genes encodes an enzyme that is localized to the cytosol. In one embodiment, the recombinant microorganisms comprise an isobutanol producing metabolic pathway with at least one isobutanol pathway enzyme localized in the cytosol. In another embodiment, the recombinant microorganisms comprise an isobutanol producing metabolic pathway with at least two isobutanol pathway enzymes localized in the cytosol. In yet another embodiment, the recombinant microorganisms comprise an isobutanol producing metabolic pathway with at least three isobutanol pathway enzymes localized in the cytosol. In yet another embodiment, the recombinant microorganisms comprise an isobutanol producing metabolic pathway with at least four isobutanol pathway enzymes localized in the cytosol. In an exemplary embodiment, the recombinant microorganisms comprise an isobutanol producing metabolic pathway with five isobutanol pathway enzymes localized in the cytosol. In yet another exemplary embodiment, the recombinant microorganisms comprise an isobutanol producing metabolic pathway with all isobutanol pathway enzymes localized in the cytosol. Isobutanol producing metabolic pathways in which one or more genes are localized to the cytosol are described in commonly owned and co-pending U.S. application Ser. No. 12/855,276, which is herein incorporated by reference in its entirety for all purposes.

As is understood in the art, a variety of organisms can serve as sources for the isobutanol pathway enzymes, including, but not limited to, *Saccharomyces* spp., including *S. cerevisiae* and *S. uvarum*, *Kluyveromyces* spp., including *K. thermotolerans*, *K. lactis*, and *K. marxianus*, *Pichia* spp., *Hansenula* spp., including *H. polymorpha*, *Candida* spp., *Trichosporon* spp., *Yamadazyma* spp., including *Y.* spp. *stipitis*, *Torulaspora pretoriensis*, *Issatchenkia orientalis*, *Schizosaccharomyces* spp., including *S. pombe*, *Cryptococcus* spp., *Aspergillus* spp., *Neurospora* spp., or *Ustilago* spp. Sources of genes from anaerobic fungi include, but not limited to, *Piromyces* spp., *Orpinomyces* spp., or *Neocallimastix* spp. Sources of prokaryotic enzymes that are useful include, but not limited to, *Escherichia. coli, Zymomonas mobilis, Staphylococcus aureus, Bacillus* spp., *Clostridium* spp., *Corynebacterium* spp., *Pseudomonas* spp., *Lactococcus* spp., *Enterobacter* spp., *Streptococcus* spp., and *Salmonella* spp.

In some embodiments, one or more of these enzymes can be encoded by native genes. Alternatively, one or more of these enzymes can be encoded by heterologous genes. For example, ALS can be encoded by the alsS gene of *B. subtilis*, alsS of *L. lactis*, or the ilvK gene of *K. pneumonia*. For example, KARI can be encoded by the ilvC gene of *E. coli, L. lactis, C. glutamicum, M. maripaludis*, or *Piromyces* sp E2. For example, DHAD can be encoded by the ilvD gene of *E. coli, C. glutamicum*, or *L. lactis*. For example, KIVD can be encoded by the kivD or kdcA gene of *L. lactis*. For example, ADH can be encoded by ADH2, ADH6, or ADH7 of *S. cerevisiae* or the adhA gene of *L. lactis*.

In one embodiment, pathway steps 2 and 5 may be carried out by KARI and ADH enzymes that utilize NADH (rather than NADPH) as a co-factor. Such enzymes are described in the commonly owned and co-pending publication, US 2010/0143997, as well as commonly owned and co-pending U.S. patent application Ser. No. 13/025,805, both of which are herein incorporated by reference in their entirety for all purposes. The present inventors have found that utilization of NADH-dependent KARI and ADH enzymes to catalyze pathway steps 2 and 5, respectively, surprisingly enables production of isobutanol under anaerobic conditions. Thus, in one embodiment, the recombinant microorganisms of the present invention may use an NADH-dependent KARI to catalyze the conversion of acetolactate to produce 2,3-dihydroxyisovalerate. In another embodiment, the recombinant microorganisms of the present invention may use an NADH-dependent ADH to catalyze the conversion of isobutyraldehyde to produce isobutanol. In yet another embodiment, the recombinant microorganisms of the present invention may use both an NADH-dependent KARI to catalyze the conversion of acetolactate to produce 2,3-dihydroxyisovalerate, and an NADH-dependent ADH to catalyze the conversion of isobutyraldehyde to produce isobutanol.

In another embodiment, the yeast microorganism may be engineered to have increased ability to convert pyruvate to isobutanol. In one embodiment, the yeast microorganism may be engineered to have increased ability to convert pyruvate to isobutyraldehyde. In another embodiment, the yeast microorganism may be engineered to have increased ability to convert pyruvate to keto-isovalerate. In another embodiment, the yeast microorganism may be engineered to have increased ability to convert pyruvate to 2,3-dihydroxyisovalerate. In another embodiment, the yeast microorganism may be engineered to have increased ability to convert pyruvate to acetolactate.

Furthermore, any of the genes encoding the foregoing enzymes (or any others mentioned herein (or any of the regulatory elements that control or modulate expression thereof)) may be optimized by genetic/protein engineering techniques, such as directed evolution or rational mutagenesis, which are known to those of ordinary skill in the art. Such action allows those of ordinary skill in the art to optimize the enzymes for expression and activity in yeast.

As described herein, the present inventors have discovered that reducing the expression and/or activity of one or more transporter proteins in yeast can improve production of the isobutanol in recombinant yeast microorganisms comprising an isobutanol producing metabolic pathway. Without being bound to any theory, it is believed that by modifying the expression or activity of one or more transporter proteins the secretion of acetolactate and/or isobutanol is altered. This is particularly unexpected, as no transporters for these compounds have been described in yeast.

Reduced Expression and/or Activity of Endogenous Transporter Proteins

As described herein, the present inventors have found that by reducing the expression and/or activity of one or more endogenous transporter proteins in yeast can improve production of the isobutanol in recombinant yeast microorganisms comprising an isobutanol producing metabolic pathway.

Accordingly, one aspect of the invention relates to a recombinant microorganism for producing isobutanol, wherein said recombinant microorganism comprises an isobutanol producing metabolic pathway and wherein said recombinant microorganism is (a) engineered to reduce the expression and/or activity of one or more endogenous transporter proteins and/or is (b) substantially free of the expression and/or activity of one or more endogenous transporter proteins.

In various embodiments described herein, one or more of the endogenous transporter proteins is selected from the group consisting of the oligopeptide transporter (OPT) superfamily, the ATP binding cassette (ABC) transporter superfamily, the major facilitator superfamily (MFS), and the amino acid-polyamine-organocation (APC) superfamily. In some embodiments, one or more of the endogenous transporter proteins is a yeast member of the OPT, ABC, MFS, or APC superfamily. In some embodiments, the expression and/or activity of least two members of the OPT, ABC, MFS, or APC superfamilies is reduced. In yet other embodiments, the expression and/or activity of at least three, four, five, six, seven, or more members of the OPT, ABC, MFS, or APC superfamilies is reduced. In one embodiment, the transporters engineered to have reduced expression and/or activity are from the same family. In other embodiments, the transporters engineered to have reduced expression and/or activity are from different families (e.g., one, two, three or more transporters of the ABC superfamily are engineered to have reduced expression and/or activity and/or one, two, three or more transporters from the MFS superfamily are engineered to have reduced expression and/or activity).

In one embodiment, one or more of the endogenous transporter proteins is a member of the oligopeptide transporter (OPT) superfamily. In some embodiments, the OPT superfamily member is a protein encoded by a gene selected from the group consisting of OPT1, OPT2, and YGL141W, or homologs or variants thereof. In an exemplary embodiment, the OPT superfamily member is the S. cerevisiae protein, Opt1p (SEQ ID NO: 2), or a homolog or variant thereof. In another exemplary embodiment, the OPT superfamily member is the S. cerevisiae protein, Opt2p (SEQ ID NO: 4), or a homolog or variant thereof.

In one embodiment, one or more of the endogenous transporter proteins is a member of the ATP binding cassette (ABC) transporter superfamily. In some embodiments, the ABC superfamily member is a protein encoded by a gene selected from the group consisting of ADP1, ARB1, ATM1, AUS1, BPT1, MDL1, MDL2, NFT1, PDR5, PDR10, PDR11, PDR12, PDR15, PDR18, PXA1, PXA2, RLI1, SNQ2, STE6, VMA8, VMR1, YBT1, YCF1, YOR1, YKR104W, and YOL075C, or homologs or variants thereof. In an exemplary embodiment, the ABC superfamily member is the S. cerevisiae protein Adp1p (SEQ ID NO: 6), or a homolog or variant thereof. In another exemplary embodiment, the ABC superfamily member is the S. cerevisiae protein Pdr12p (SEQ ID NO: 8), or a homolog or variant thereof.

In a further embodiment, the expression and/or activity of a transcriptional regulator of Pdr12p may be reduced. In an exemplary embodiment, the transcriptional regulator of Pdr12p is the S. cerevisiae protein War1p (SEQ ID NO: 18), or a homolog or variant thereof. War1p is a transcription factor controlling weak acid stress response in yeast and is a necessary component for induction of PDR12, the gene coding for Pdr12p (See, e.g., Kren et al., 2003, Mol. Cell. Biol. 23(5): 1775-85, see also Schüller et al., 2004, MBC 15: 706-20). Accordingly, reducing the expression and/or activity of War1p, or a homolog or variant thereof, in a yeast species has the effect of reducing Pdr12p expression.

In one embodiment, one or more of the endogenous transporter proteins is a member of the major facilitator (MFS) superfamily. In some embodiments, the MFS superfamily member is a protein encoded by a gene selected from the group consisting of AQR1, ATR1, AZR1, DTR1, ENB1, FLR1, HOL1, PDR8, QDR1, QDR2, QDR3, SEO1, SGE1, SSU1, THI7, TPN1, VBA5, and YIL166C, or homologs or variants thereof. In an exemplary embodiment, the MFS superfamily member is the S. cerevisiae protein Aqr1p (SEQ ID NO: 10), or a homolog or variant thereof. In another exemplary embodiment, the MFS superfamily member is the S. cerevisiae protein Qdr1p (SEQ ID NO: 12), or a homolog or variant thereof. In yet another exemplary embodiment, the MFS superfamily member is the S. cerevisiae protein Qdr2p (SEQ ID NO: 14), or a homolog or variant thereof.

In one embodiment, one or more of the endogenous transporter proteins is a member of the amino acid-polyamine-organocation (APC) superfamily. In some embodiments, the APC superfamily member is a protein encoded by a gene selected from the group consisting of AGP1, AGP2, AGP3, ALP1, BAP2, BAP3, BIO5, CAN1, DIP5, GAP1, GNP1, HIP1, HNM1, LYP1, MMP1, PUT4, SAM3, SSY1, TAT1, TAT2, TPO1, TPO2, TPO3, TPO4, TPO5, and UGA4, or homologs or variants thereof. In an exemplary embodiment, the APC superfamily member is the S. cerevisiae protein, Dip5p (SEQ ID NO: 16), or a homolog or variant thereof.

In one embodiment, the invention is directed to a recombinant microorganism for producing isobutanol, wherein said recombinant microorganism comprises an isobutanol producing metabolic pathway and wherein said recombinant microorganism is engineered to reduce the expression or activity of an endogenous transporter protein selected from at least two of the following: (i) an OPT superfamily member; (ii) an ABC superfamily member; (iii) a MFS superfamily member; and/or (iv) an APC superfamily member. In another embodiment, the invention is directed to a recombinant microorganism for producing isobutanol, wherein said recombinant microorganism comprises an isobutanol producing metabolic pathway and wherein said recombinant microorganism is engineered to reduce the expression or activity of an endogenous transporter protein selected from at least three of the following: (i) an OPT superfamily member; (ii) an ABC superfamily member; (iii) a MFS superfamily member; and/or (iv) an APC superfamily member. In yet another embodiment, the invention is directed to a recombinant microorganism for producing isobutanol, wherein said recombinant microorganism comprises an isobutanol producing metabolic pathway and wherein said recombinant microorganism is engineered to reduce the expression or activity of an endogenous transporter protein selected from all four of the following: (i) an OPT superfamily member; (ii) an ABC superfamily member; (iii) a MFS superfamily member; and/or (iv) an APC superfamily member.

As would be understood by one skilled in the art equipped with the instant disclosure, the expression and/or activity of multiple endogenous transporters can be reduced via the methods described herein. In one embodiment, the expression and/or activity of at least one endogenous transporter is reduced or eliminated. In another embodiment, the expression and/or activity of at least two endogenous transporters is reduced or eliminated. In yet another embodiment, the expression and/or activity of at least three endogenous transporters is reduced or eliminated. In yet another embodiment, the expression and/or activity of at four, five, six, or more endogenous transporters is reduced or eliminated. In an exemplary embodiment, the expression and/or activity of Aqr1p alone is reduced. In another exemplary embodiment, the expression and/or activity of Opt1p alone is reduced. In yet another exemplary embodiment, the expression and/or activity of Pdr12p alone is reduced. In yet another exemplary embodiment, the expression and/or activity of Aqr1p and Opt1p is reduced. In yet another exemplary embodiment, the expression and/or activity of Aqr1p and Pdr12p is reduced. In yet another exemplary embodiment, the expression and/or activity of Opt1p and Pdr12p is reduced. In yet another exemplary embodiment, the expression and/or activity of Aqr1p, Opt1p, and Pdr12p is reduced. In yet another exemplary embodiment, the expression and/or activity of Aqr1p, Opt1p, and/or Pdr12p is reduced, and is combined with the reduced expression and/or activity of one or more additional endogenous transporter proteins.

In one embodiment, the recombinant microorganism of the invention includes a mutation in at least one gene encoding for an endogenous transporter resulting in a reduction of transporter activity of a polypeptide encoded by said gene. In another embodiment, the recombinant microorganism includes a partial deletion of a gene encoding for a transporter gene resulting in a reduction of endogenous transporter activity of a polypeptide encoded by the gene. In another embodiment, the recombinant microorganism comprises a complete deletion of a gene encoding for an endogenous transporter resulting in a reduction of endogenous transporter activity of a polypeptide encoded by the gene. In yet another embodiment, the recombinant microorganism includes a modification of the regulatory region associated with the transporter gene encoding for an endogenous transporter resulting in reduced or altered expression of a transporter polypeptide encoded by said gene. In yet another embodiment, the recombinant microorganism comprises a modification of a transcriptional regulator resulting in reduced or altered transcription of gene encoding for an endogenous transporter. In yet another embodiment, the recombinant microorganism comprises mutations in all genes encoding for an endogenous transporter resulting in a reduction of activity of a polypeptide encoded by the gene(s).

In various embodiments, the endogenous transporter gene is the *S. cerevisiae* version of the gene or a homolog thereof. Any method can be used to identify genes that encode for the endogenous transporter of interest in a variety of yeast strains. Generally, genes that are homologous or similar to the endogenous transporter of interest can be identified by functional, structural, and/or genetic analysis. Homologous or similar polypeptides will generally have functional, structural, or genetic similarities.

The chromosomal location of the genes encoding endogenous *S. cerevisiae* transporter proteins may be syntenic to chromosomes in many related yeast [Byrne, K. P. and K. H. Wolfe (2005) "The Yeast Gene Order Browser: combining curated homology and syntenic context reveals gene fate in polyploid species." *Genome Res.* 15(10):1456-61. Scannell, D. R., K. P. Byrne, J. L. Gordon, S. Wong, and K. H. Wolfe (2006) "Multiple rounds of speciation associated with reciprocal gene loss in polyploidy yeasts." *Nature* 440: 341-5. Scannell, D. R., A. C. Frank, G. C. Conant, K. P. Byrne, M. Woolfit, and K. H. Wolfe (2007) "Independent sorting-out of thousands of duplicated gene pairs in two yeast species descended from a whole-genome duplication." *Proc Natl Acad Sci USA* 104: 8397-402]. Using this syntenic relationship, species-specific versions of these genes are readily identified in a variety of yeast, including but not limited to, *Ashbya gossypii, Candida glabrata, Kluyveromyces lactis, Kluyveromyces polyspora, Kluyveromyces thermotolerans, Kluyveromyces waltii, Saccharomyces kluyveri, Saccharomyces castelli, Saccharomyces bayanus,* and *Zygosaccharomyces rouxii*.

As would be understood in the art, naturally occurring homologs of the aforementioned transporters in yeast other than *S. cerevisiae* can similarly be inactivated using the methods of the present invention. Transporter homologs and methods of identifying such homologs are described herein. A representative list of *S. cerevisiae* transporter genes and their respective homologs in yeast other than *S. cerevisiae* is included in Table 1.

TABLE 1

S. cerevisiae Transporter Proteins and Yeast Homologs Thereof.

| Origin | SEQ ID NO: |
|---|---|
| Opt1p | |
| S. cerevisiae | 2 |
| K. lactis | 20 |
| A. gossypii | 22 |
| S. kluyveri | 24 |
| K. waltii | 26 |
| K. thermotolerans | 28 |
| K. thermotolerans | 30 |
| Z. rouxii | 32 |
| S. kluyveri | 34 |
| K. waltii | 36 |

TABLE 1-continued

S. cerevisiae Transporter Proteins and Yeast Homologs Thereof.

| Origin | SEQ ID NO: |
|---|---|
| S. kluyveri | 38 |
| K. lactis | 40 |
| S. bayanus | 42 |
| Opt2p | |
| S. cerevisiae | 4 |
| K. lactis | 44 |
| K. waltii | 46 |
| A. gossypii | 48 |
| S. kluyveri | 50 |
| K. thermotolerans | 52 |
| K. polyspora | 54 |
| A. gossypii | 56 |
| S. kluyveri | 58 |
| S. kluyveri | 60 |
| K. waltii | 62 |
| S. kluyveri | 64 |
| S. bayanus | 66 |
| K. lactis | 68 |
| Z. rouxii | 70 |
| A. gossypii | 72 |
| K. lactis | 74 |
| A. gossypii | 76 |
| K. thermotolerans | 78 |
| Z. rouxii | 80 |
| K. waltii | 82 |
| Z. rouxii | 84 |
| S. bayanus | 86 |
| Adp1p | |
| S. cerevisiae | 6 |
| S. kluyveri | 88 |
| A. gossypii | 90 |
| K. lactis | 92 |
| K. waltii | 94 |
| C. glabrata | 96 |
| K. polyspora | 98 |
| S. bayanus | 100 |
| Z. rouxii | 102 |
| K. thermotolerans | 104 |
| S. castelli | 106 |
| Pdr12p | |
| S. cerevisiae | 8 |
| K. waltii | 108 |
| C. glabrata | 110 |
| A. gossypii | 112 |
| A. gossypii | 114 |
| Z. rouxii | 116 |
| Z. rouxii | 118 |
| K. polyspora | 120 |
| K. waltii | 122 |
| K. lactis | 124 |
| S. castelli | 126 |
| S. kluyveri | 128 |
| S. bayanus | 130 |
| S. cerevisiae (Pdr18p) | 132 |
| C. glabrata | 134 |
| S. bayanus | 136 |
| S. castelli | 138 |
| Z. rouxii | 140 |
| S. castelli | 142 |
| Z. rouxii | 144 |
| S. kluyveri | 146 |
| C. glabrata | 148 |
| Z. rouxii | 150 |
| S. kluyveri | 152 |
| S. cerevisiae (Pdr5p) | 154 |
| K. thermotolerans | 156 |
| S. castelli | 158 |
| A. gossypii | 160 |
| K. lactis | 162 |
| S. cerevisiae (Pdr10p) | 164 |
| S. cerevisiae (Snq2p) | 166 |
| S. bayanus | 168 |
| K. waltii | 170 |
| K. waltii | 172 |
| Z. rouxii | 174 |
| K. lactis | 176 |
| S. castelli | 178 |
| S. castelli | 180 |
| S. bayanus | 182 |
| Z. rouxii | 184 |
| S. kluyveri | 186 |
| S. castelli | 188 |
| K. thermotolerans | 190 |
| C. glabrata | 192 |
| S. cerevisiae (Pdr10p) | 194 |
| S. kluyveri | 196 |
| K. lactis | 198 |
| S. castelli | 200 |
| C. glabrata | 202 |
| S. cerevisiae (Pdr15p) | 204 |
| S. kluyveri | 206 |
| S. kluyveri | 208 |
| S. castelli | 210 |
| Z. rouxii | 212 |
| K. polyspora | 214 |
| A. gossypii | 216 |
| S. bayanus | 218 |
| S. kluyveri | 220 |
| S. castelli | 222 |
| K. waltii | 224 |
| K. polyspora | 226 |
| S. cerevisiae (Aus1p) | 228 |
| Aqr1p, Qdr1p, and Qdr2p | |
| S. cerevisiae (Aqr1p) | 10 |
| S. cerevisiae (Qdr1p) | 12 |
| S. cerevisiae (Qdr2p) | 14 |
| S. castelli | 230 |
| S. bayanus | 232 |
| K. polyspora | 234 |
| S. kluyveri | 236 |
| K. lactis | 238 |
| S. bayanus | 240 |
| C. glabrata | 242 |
| K. waltii | 244 |
| S. castelli | 246 |
| K. waltii | 248 |
| K. thermotolerans | 250 |
| K. lactis | 252 |
| S. bayanus | 254 |
| S. kluyveri | 256 |
| A. gossypii | 258 |
| S. castelli | 260 |
| K. polyspora | 262 |
| K. thermotolerans | 264 |
| C. glabrata | 266 |
| Z. rouxii | 268 |
| Dip5p | |
| S. cerevisiae | 16 |
| A. gossypii | 270 |
| K. lactis | 272 |
| K. polyspora | 274 |
| S. kluyveri | 276 |
| S. castelli | 278 |
| K. thermotolerans | 280 |
| C. glabrata | 282 |
| S. bayanus | 284 |
| Z. rouxii | 286 |
| K. waltii | 288 |
| War1p (Transcription Factor) | |
| S. cerevisiae | 18 |
| K. waltii | 290 |
| S. kluyveri | 292 |
| K. lactis | 294 |
| C. glabrata | 296 |
| K. polyspora | 298 |
| K. thermotolerans | 300 |

TABLE 1-continued

S. cerevisiae Transporter Proteins and Yeast Homologs Thereof.

| Origin | SEQ ID NO: |
|---|---|
| A. gossypii | 302 |
| Z. rouxii | 304 |
| S. castelli | 306 |
| S. bayanus | 308 |

As is understood by those skilled in the art, there are several additional mechanisms available for reducing or disrupting the activity of a transporter protein, including, but not limited to, the use of a regulated promoter, use of a weak constitutive promoter, disruption of one of the two copies of the gene in a diploid yeast, disruption of both copies of the gene in a diploid yeast, expression of an antisense nucleic acid, expression of an siRNA, over expression of a negative regulator of the endogenous promoter, alteration of the activity of an endogenous or heterologous gene, use of a heterologous gene with lower specific activity, the like or combinations thereof.

In some embodiments, it may be preferable to produce an inactive version of the transporter protein. Methods for creating such inactive versions are known in the art. In one embodiment, an inactive version is made via one or more point mutations that reduce protein activity, but still allow for the transporter protein targeted to the yeast plasma membrane.

As described herein, strains that naturally produce low levels of one or more of the endogenous transporter proteins can also have applicability for producing increased levels of isobutanol. As would be understood by one skilled in the art equipped with the instant disclosure, strains that naturally produce low levels of one or more endogenous transporter proteins may inherently exhibit low or undetectable levels of endogenous transporter activity, resulting in the reduced transport or acetolactate and/or isobutanol, a trait favorable for the production of isobutanol.

The Microorganism in General

As described herein, the recombinant microorganisms of the present invention can express a plurality of heterologous and/or native enzymes involved in pathways for the production of a beneficial metabolite such as isobutanol.

As described herein, "engineered" or "modified" microorganisms are produced via the introduction of genetic material into a host or parental microorganism of choice and/or by modification of the expression of native genes, thereby modifying or altering the cellular physiology and biochemistry of the microorganism. Through the introduction of genetic material and/or the modification of the expression of native genes the parental microorganism acquires new properties, e.g., the ability to produce a new, or greater quantities of, an intracellular and/or extracellular metabolite. As described herein, the introduction of genetic material into and/or the modification of the expression of native genes in a parental microorganism results in a new or modified ability to produce beneficial metabolites such as isobutanol from a suitable carbon source. The genetic material introduced into and/or the genes modified for expression in the parental microorganism contains gene(s), or parts of genes, coding for one or more of the enzymes involved in a biosynthetic pathway for the production of isobutanol and may also include additional elements for the expression and/or regulation of expression of these genes, e.g., promoter sequences.

In addition to the introduction of a genetic material into a host or parental microorganism, an engineered or modified microorganism can also include the alteration, disruption, deletion or knocking-out of a gene or polynucleotide to alter the cellular physiology and biochemistry of the microorganism. Through the alteration, disruption, deletion or knocking-out of a gene or polynucleotide, the microorganism acquires new or improved properties (e.g., the ability to produce a new metabolite or greater quantities of an intracellular metabolite, to improve the flux of a metabolite down a desired pathway, and/or to reduce the production of by-products).

Recombinant microorganisms provided herein may also produce metabolites in quantities not available in the parental microorganism. A "metabolite" refers to any substance produced by metabolism or a substance necessary for or taking part in a particular metabolic process. A metabolite can be an organic compound that is a starting material (e.g., glucose or pyruvate), an intermediate (e.g., 2-ketoisovalerate), or an end product (e.g., isobutanol) of metabolism. Metabolites can be used to construct more complex molecules, or they can be broken down into simpler ones. Intermediate metabolites may be synthesized from other metabolites, perhaps used to make more complex substances, or broken down into simpler compounds, often with the release of chemical energy.

The disclosure identifies specific genes useful in the methods, compositions and organisms of the disclosure; however it will be recognized that absolute identity to such genes is not necessary. For example, changes in a particular gene or polynucleotide comprising a sequence encoding a polypeptide or enzyme can be performed and screened for activity. Typically such changes comprise conservative mutations and silent mutations. Such modified or mutated polynucleotides and polypeptides can be screened for expression of a functional enzyme using methods known in the art.

Due to the inherent degeneracy of the genetic code, other polynucleotides which encode substantially the same or functionally equivalent polypeptides can also be used to clone and express the polynucleotides encoding such enzymes.

As will be understood by those of skill in the art, it can be advantageous to modify a coding sequence to enhance its expression in a particular host. The genetic code is redundant with 64 possible codons, but most organisms typically use a subset of these codons. The codons that are utilized most often in a species are called optimal codons, and those not utilized very often are classified as rare or low-usage codons. Codons can be substituted to reflect the preferred codon usage of the host, in a process sometimes called "codon optimization" or "controlling for species codon bias."

Optimized coding sequences containing codons preferred by a particular prokaryotic or eukaryotic host (Murray et al., 1989, Nucl Acids Res. 17: 477-508) can be prepared, for example, to increase the rate of translation or to produce recombinant RNA transcripts having desirable properties, such as a longer half-life, as compared with transcripts produced from a non-optimized sequence. Translation stop codons can also be modified to reflect host preference. For example, typical stop codons for S. cerevisiae and mammals are UAA and UGA, respectively. The typical stop codon for monocotyledonous plants is UGA, whereas insects and E. coli commonly use UAA as the stop codon (Dalphin et al., 1996, Nucl Acids Res. 24: 216-8). Methodology for optimizing a nucleotide sequence for expression in a plant is provided, for example, in U.S. Pat. No. 6,015,891, and the references cited therein.

Those of skill in the art will recognize that, due to the degenerate nature of the genetic code, a variety of DNA compounds differing in their nucleotide sequences can be used to encode a given enzyme of the disclosure. The native DNA sequence encoding the biosynthetic enzymes described above are referenced herein merely to illustrate an embodiment of the disclosure, and the disclosure includes DNA compounds of any sequence that encode the amino acid sequences of the polypeptides and proteins of the enzymes utilized in the methods of the disclosure. In similar fashion, a polypeptide can typically tolerate one or more amino acid substitutions, deletions, and insertions in its amino acid sequence without loss or significant loss of a desired activity. The disclosure includes such polypeptides with different amino acid sequences than the specific proteins described herein so long as the modified or variant polypeptides have the enzymatic anabolic or catabolic activity of the reference polypeptide. Furthermore, the amino acid sequences encoded by the DNA sequences shown herein merely illustrate embodiments of the disclosure.

In addition, homologs of enzymes useful for generating metabolites are encompassed by the microorganisms and methods provided herein.

As used herein, two proteins (or a region of the proteins) are substantially homologous when the amino acid sequences have at least about 30%, 40%, 50% 60%, 65%, 70%, 75%, 80%, 85%, 90%, 91%, 92%, 93%, 94%, 95%, 96%, 97%, 98%, or 99% identity. To determine the percent identity of two amino acid sequences, or of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). In one embodiment, the length of a reference sequence aligned for comparison purposes is at least 30%, typically at least 40%, more typically at least 50%, even more typically at least 60%, and even more typically at least 70%, 80%, 90%, 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

When "homologous" is used in reference to proteins or peptides, it is recognized that residue positions that are not identical often differ by conservative amino acid substitutions. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. In cases where two or more amino acid sequences differ from each other by conservative substitutions, the percent sequence identity or degree of homology may be adjusted upwards to correct for the conservative nature of the substitution. Means for making this adjustment are well known to those of skill in the art (See, e.g., Pearson W. R., 1994, *Methods in Mol Biol* 25: 365-89).

The following six groups each contain amino acids that are conservative substitutions for one another: 1) Serine (S), Threonine (T); 2) Aspartic Acid (D), Glutamic Acid (E); 3) Asparagine (N), Glutamine (Q); 4) Arginine (R), Lysine (K); 5) Isoleucine (I), Leucine (L), Alanine (A), Valine (V), and 6) Phenylalanine (F), Tyrosine (Y), Tryptophan (W).

Sequence homology for polypeptides, which is also referred to as percent sequence identity, is typically measured using sequence analysis software. See commonly owned and co-pending application US 2009/0226991. A typical algorithm used comparing a molecule sequence to a database containing a large number of sequences from different organisms is the computer program BLAST. When searching a database containing sequences from a large number of different organisms, it is typical to compare amino acid sequences. Database searching using amino acid sequences can be measured by algorithms described in commonly owned and co-pending application US 2009/0226991.

It is understood that a range of microorganisms can be modified to include an isobutanol producing metabolic pathway suitable for the production of isobutanol. In various embodiments, the microorganisms may be selected from yeast microorganisms. Yeast microorganisms for the production of isobutanol may be selected based on certain characteristics:

One characteristic may include the property that the microorganism is selected to convert various carbon sources into isobutanol. The term "carbon source" generally refers to a substance suitable to be used as a source of carbon for prokaryotic or eukaryotic cell growth. Examples of suitable carbon sources are described in commonly owned and co-pending application US 2009/0226991. Accordingly, in one embodiment, the recombinant microorganism herein disclosed can convert a variety of carbon sources to products, including but not limited to glucose, galactose, mannose, xylose, arabinose, lactose, sucrose, and mixtures thereof.

The recombinant microorganism may thus further include a pathway for the production of isobutanol from five-carbon (pentose) sugars including xylose. Most yeast species metabolize xylose via a complex route, in which xylose is first reduced to xylitol via a xylose reductase (XR) enzyme. The xylitol is then oxidized to xylulose via a xylitol dehydrogenase (XDH) enzyme. The xylulose is then phosphorylated via a xylulokinase (XK) enzyme. This pathway operates inefficiently in yeast species because it introduces a redox imbalance in the cell. The xylose-to-xylitol step uses NADH as a cofactor, whereas the xylitol-to-xylulose step uses NADPH as a cofactor. Other processes must operate to restore the redox imbalance within the cell. This often means that the organism cannot grow anaerobically on xylose or other pentose sugars. Accordingly, a yeast species that can efficiently ferment xylose and other pentose sugars into a desired fermentation product is therefore very desirable.

Thus, in one aspect, the recombinant microorganism is engineered to express a functional exogenous xylose isomerase. Exogenous xylose isomerases functional in yeast are known in the art. See, e.g., Rajgarhia et al., US2006/0234364, which is herein incorporated by reference in its entirety. In an embodiment according to this aspect, the exogenous xylose isomerase gene is operatively linked to promoter and terminator sequences that are functional in the yeast cell. In a preferred embodiment, the recombinant microorganism further has a deletion or disruption of a native gene that encodes for an enzyme (e.g., XR and/or XDH) that catalyzes the conversion of xylose to xylitol. In a further preferred embodiment, the recombinant microorganism also contains a functional, exogenous xylulokinase (XK) gene operatively linked to promoter and terminator sequences that are functional in the yeast cell. In one embodiment, the xylulokinase (XK) gene is overexpressed.

In one embodiment, the microorganism has reduced or no pyruvate decarboxylase (PDC) activity. PDC catalyzes the decarboxylation of pyruvate to acetaldehyde, which is then reduced to ethanol by ADH via an oxidation of NADH to NAD+. Ethanol production is the main pathway to oxidize the NADH from glycolysis. Deletion of this pathway increases the pyruvate and the reducing equivalents (NADH) available for the isobutanol producing metabolic pathway. Accordingly, deletion of genes encoding for pyruvate decarboxylases can further increase the yield of desired metabolites.

In another embodiment, the microorganism has reduced or no glycerol-3-phosphate dehydrogenase (GPD) activity. GPD catalyzes the reduction of dihydroxyacetone phosphate (DHAP) to glycerol-3-phosphate (G3P) via the oxidation of NADH to NAD+. Glycerol is then produced from G3P by Glycerol-3-phosphatase (GPP). Glycerol production is a secondary pathway to oxidize excess NADH from glycolysis. Reduction or elimination of this pathway would increase the pyruvate and reducing equivalents (NADH) available for the isobutanol producing metabolic pathway. Thus, deletion of genes encoding for glycerol-3-phosphate dehydrogenases can further increase the yield of desired metabolites, including isobutanol.

In yet another embodiment, the microorganism has reduced or no PDC activity and reduced or no GPD activity. PDC-minus, GPD-minus yeast production strains are described in commonly owned and co-pending publications, US 2009/0226991 and US 2011/0020889, both of which are herein incorporated by reference in their entireties for all purposes.

In yet another embodiment, the microorganism has reduced or no 3-keto acid reductase (3-KAR) activity. 3-keto acid reductase catalyzes the conversion of 3-keto acids (e.g., acetolactate) to 3-hydroxyacids (e.g., DH2MB). 3-KAR-minus yeast production strains are described in commonly owned and co-pending U.S. application Ser. No. 13/025,801, which is herein incorporated by reference in its entirety for all purposes.

In yet another embodiment, the microorganism has reduced or no aldehyde dehydrogenase (ALDH) activity. Aldehyde dehydrogenases catalyze the conversion of aldehydes (e.g., isobutyraldehyde) to acid by-products (e.g., isobutyrate). ALDH-minus yeast production strains are described in commonly owned and co-pending U.S. application Ser. No. 13/025,801, which is herein incorporated by reference in its entirety for all purposes.

In one embodiment, the yeast microorganisms may be selected from the "*Saccharomyces* Yeast Clade", as described in commonly owned and co-pending application US 2009/0226991.

The term "*Saccharomyces sensu stricto*" taxonomy group is a cluster of yeast species that are highly related to *S. cerevisiae* (Rainieri et al., 2003, *J. Biosci Bioengin* 96: 1-9). *Saccharomyces sensu stricto* yeast species include but are not limited to *S. cerevisiae, S. kudriavzevii, S. mikatae, S. bayanus, S. uvarum, S. carocanis* and hybrids derived from these species (Masneuf et al., 1998, *Yeast* 7: 61-72).

An ancient whole genome duplication (WGD) event occurred during the evolution of the hemiascomycete yeast and was discovered using comparative genomic tools (Kellis et al., 2004, *Nature* 428: 617-24; Dujon et al., 2004, *Nature* 430:35-44; Langkjaer et al., 2003, *Nature* 428: 848-52; Wolfe et al., 1997, *Nature* 387: 708-13). Using this major evolutionary event, yeast can be divided into species that diverged from a common ancestor following the WGD event (termed "post-WGD yeast" herein) and species that diverged from the yeast lineage prior to the WGD event (termed "pre-WGD yeast" herein).

Accordingly, in one embodiment, the yeast microorganism may be selected from a post-WGD yeast genus, including but not limited to *Saccharomyces* and *Candida*. The favored post-WGD yeast species include: *S. cerevisiae, S. uvarum, S. bayanus, S. paradoxus, S. castelli*, and *C. glabrata*.

In another embodiment, the yeast microorganism may be selected from a pre-whole genome duplication (pre-WGD) yeast genus including but not limited to *Saccharomyces, Kluyveromyces, Candida, Pichia, Issatchenkia, Debaryomyces, Hansenula, Yarrowia* and, *Schizosaccharomyces*. Representative pre-WGD yeast species include: *S. kluyveri, K. thermotolerans, K. marxianus, K. waltii, K. lactis, C. tropicalis, P. pastoris, P. anomala, P. stipitis, I. orientalis, I. occidentalis, I. scutulata, D. hansenii, H. anomala, Y. lipolytica*, and *S. pombe*.

A yeast microorganism may be either Crabtree-negative or Crabtree-positive as described in described in commonly owned and co-pending application US 2009/0226991. In one embodiment the yeast microorganism may be selected from yeast with a Crabtree-negative phenotype including but not limited to the following genera: *Saccharomyces, Kluyveromyces, Pichia, Issatchenkia, Hansenula*, and *Candida*. Crabtree-negative species include but are not limited to: *S. kluyveri, K. lactis, K. marxianus, P. anomala, P. stipitis, I. orientalis, I. occidentalis, I. scutulata, H. anomala*, and *C. utilis*. In another embodiment, the yeast microorganism may be selected from yeast with a Crabtree-positive phenotype, including but not limited to *Saccharomyces, Kluyveromyces, Zygosaccharomyces, Debaryomyces, Pichia* and *Schizosaccharomyces*. Crabtree-positive yeast species include but are not limited to: *S. cerevisiae, S. uvarum, S. bayanus, S. paradoxus, S. castelli, K. thermotolerans, C. glabrata, Z. bailli, Z. rouxii, D. hansenii, P. pastorius*, and *S. pombe*.

Another characteristic may include the property that the microorganism is that it is non-fermenting. In other words, it cannot metabolize a carbon source anaerobically while the yeast is able to metabolize a carbon source in the presence of oxygen. Nonfermenting yeast refers to both naturally occurring yeasts as well as genetically modified yeast. During anaerobic fermentation with fermentative yeast, the main pathway to oxidize the NADH from glycolysis is through the production of ethanol. Ethanol is produced by alcohol dehydrogenase (ADH) via the reduction of acetaldehyde, which is generated from pyruvate by pyruvate decarboxylase (PDC). In one embodiment, a fermentative yeast can be engineered to be non-fermentative by the reduction or elimination of the native PDC activity. Thus, most of the pyruvate produced by glycolysis is not consumed by PDC and is available for the isobutanol pathway. Deletion of this pathway increases the pyruvate and the reducing equivalents available for the biosynthetic pathway. Fermentative pathways contribute to low yield and low productivity of desired metabolites such as isobutanol. Accordingly, deletion of PDC genes may increase yield and productivity of desired metabolites such as isobutanol.

In some embodiments, the recombinant microorganisms may be microorganisms that are non-fermenting yeast microorganisms, including, but not limited to those, classified into a genera selected from the group consisting of *Tricosporon, Rhodotorula, Myxozyma*, or *Candida*. In a specific embodiment, the non-fermenting yeast is *C. xestobii*.

Methods in General
Identification of Transporter Homologs

Any method can be used to identify genes that encode for enzymes that are homologous to the genes described herein (e.g., transporter homologs). Generally, yeast genes that are homologous or similar to the transporters described herein may be identified by functional, structural, and/or genetic analysis. In most cases, homologous or similar genes and/or homologous or similar enzymes will have functional, structural, or genetic similarities.

Techniques known to those skilled in the art may be suitable to identify additional homologous genes and homologous enzymes. Generally, analogous genes and/or analogous enzymes can be identified by functional analysis and will have functional similarities. Techniques known to those skilled in the art may be suitable to identify analogous genes and analogous enzymes. For example, to identify homologous or analogous genes, proteins, or enzymes, techniques may include, but not limited to, cloning a gene by PCR using primers based on a published sequence of a gene/enzyme or by degenerate PCR using degenerate primers designed to amplify a conserved region among dehydratase genes. Further, one skilled in the art can use techniques to identify homologous or analogous genes, proteins, or enzymes with functional homology or similarity. Techniques include examining a cell or cell culture for the catalytic activity of an enzyme through in vitro enzyme assays for said activity (e.g. as described herein or in Kiritani, K. *Branched-Chain Amino Acids* Methods Enzymology, 1970), then isolating the enzyme with said activity through purification, determining the protein sequence of the enzyme through techniques such as Edman degradation, design of PCR primers to the likely nucleic acid sequence, amplification of said DNA sequence through PCR, and cloning of said nucleic acid sequence. To identify homologous or similar genes and/or homologous or similar enzymes, analogous genes and/or analogous enzymes or proteins, techniques also include comparison of data concerning a candidate gene or enzyme with databases such as BRENDA, KEGG, or MetaCYC. The candidate gene or enzyme may be identified within the above mentioned databases in accordance with the teachings herein.

Genetic Insertions and Deletions

Any method can be used to introduce a nucleic acid molecule into yeast and many such methods are well known. For example, transformation and electroporation are common methods for introducing nucleic acid into yeast cells. See, e.g., Gietz et al., 1992, *Nuc Acids Res.* 27: 69-74; Ito et al., 1983, *J. Bacteriol.* 153: 163-8; and Becker et al., 1991, *Methods in Enzymology* 194: 182-7.

In an embodiment, the integration of a gene of interest into a DNA fragment or target gene of a yeast microorganism occurs according to the principle of homologous recombination. According to this embodiment, an integration cassette containing a module comprising at least one yeast marker gene and/or the gene to be integrated (internal module) is flanked on either side by DNA fragments homologous to those of the ends of the targeted integration site (recombinogenic sequences). After transforming the yeast with the cassette by appropriate methods, a homologous recombination between the recombinogenic sequences may result in the internal module replacing the chromosomal region in between the two sites of the genome corresponding to the recombinogenic sequences of the integration cassette. (Orr-Weaver et al., 1981, *PNAS USA* 78: 6354-58).

In an embodiment, the integration cassette for integration of a gene of interest into a yeast microorganism includes the heterologous gene under the control of an appropriate promoter and terminator together with the selectable marker flanked by recombinogenic sequences for integration of a heterologous gene into the yeast chromosome. In an embodiment, the heterologous gene includes an appropriate native gene desired to increase the copy number of a native gene(s). The selectable marker gene can be any marker gene used in yeast, including but not limited to, HIS3, TRP1, LEU2, URA3, bar, ble, hph, and kan. The recombinogenic sequences can be chosen at will, depending on the desired integration site suitable for the desired application.

In another embodiment, integration of a gene into the chromosome of the yeast microorganism may occur via random integration (Kooistra et al., 2004, *Yeast* 21: 781-792).

Additionally, in an embodiment, certain introduced marker genes are removed from the genome using techniques well known to those skilled in the art. For example, URA3 marker loss can be obtained by plating URA3 containing cells in FOA (5-fluoro-orotic acid) containing medium and selecting for FOA resistant colonies (Boeke et al., 1984, *Mol. Gen. Genet* 197: 345-47).

The exogenous nucleic acid molecule contained within a yeast cell of the disclosure can be maintained within that cell in any form. For example, exogenous nucleic acid molecules can be integrated into the genome of the cell or maintained in an episomal state that can stably be passed on ("inherited") to daughter cells. Such extra-chromosomal genetic elements (such as plasmids, mitochondrial genome, etc.) can additionally contain selection markers that ensure the presence of such genetic elements in daughter cells. Moreover, the yeast cells can be stably or transiently transformed. In addition, the yeast cells described herein can contain a single copy, or multiple copies of a particular exogenous nucleic acid molecule as described above.

Reduction of Transporter Activity

Yeast microorganisms within the scope of the invention may have reduced transporter activity such as reduced Opt1p, Opt2p, Adp1p, Pdr12p, Aqr1p, Qdr1p, Qdr2p, and/or Dip5p activity, and/or have reduced transcription factor activity such as reduced War1p activity. The term "reduced" as used herein with respect to a particular polypeptide activity refers to a lower level of polypeptide activity than that measured in a comparable yeast cell of the same species. The term reduced also refers to the elimination of polypeptide activity as compared to a comparable yeast cell of the same species. Thus, yeast cells lacking activity for an endogenous transporter are considered to have reduced activity for that transporter since most, if not all, comparable yeast strains have at least some activity for that particular transporter. Such reduced transporter activities can be the result of lower transporter concentration (e.g., via reduced expression), lower specific activity of the transporter, or a combination thereof. Many different methods can be used to make yeast having reduced transporter activity. For example, a yeast cell can be engineered to have a disrupted transporter-encoding locus using common mutagenesis or knock-out technology. See, e.g., Methods in Yeast Genetics (1997 edition), Adams, Gottschling, Kaiser, and Stems, Cold Spring Harbor Press (1998). In addition, a yeast cell can be engineered to partially or completely remove the coding sequence for a particular transporter. Furthermore, the promoter sequence and/or associated regulatory elements can be mutated, disrupted, or deleted to reduce the expression of a transporter. Moreover, certain point-mutation(s) can be introduced which results in a transporter with reduced activity. Also included within the scope of this invention are yeast strains which when found in nature, are substantially free of one or more transporter activities.

Alternatively, antisense technology can be used to reduce transporter activity. For example, yeasts can be engineered to contain a cDNA that encodes an antisense molecule that prevents a transporter from being made. The term "antisense molecule" as used herein encompasses any nucleic acid molecule that contains sequences that correspond to the coding strand of an endogenous polypeptide. An antisense molecule also can have flanking sequences (e.g., regulatory sequences).

Thus antisense molecules can be ribozymes or antisense oligonucleotides. A ribozyme can have any general structure including, without limitation, hairpin, hammerhead, or axhead structures, provided the molecule cleaves RNA.

Overexpression of Heterologous Genes

Methods for overexpressing a polypeptide from a native or heterologous nucleic acid molecule are well known. Such methods include, without limitation, constructing a nucleic acid sequence such that a regulatory element promotes the expression of a nucleic acid sequence that encodes the desired polypeptide. Typically, regulatory elements are DNA sequences that regulate the expression of other DNA sequences at the level of transcription. Thus, regulatory elements include, without limitation, promoters, enhancers, and the like. For example, the exogenous genes can be under the control of an inducible promoter or a constitutive promoter. Moreover, methods for expressing a polypeptide from an exogenous nucleic acid molecule in yeast are well known. For example, nucleic acid constructs that are used for the expression of exogenous polypeptides within *Kluyveromyces* and *Saccharomyces* are well known (see, e.g., U.S. Pat. Nos. 4,859,596 and 4,943,529, for *Kluyveromyces* and, e.g., Gellissen et al., Gene 190(1):87-97 (1997) for *Saccharomyces*). Yeast plasmids have a selectable marker and an origin of replication. In addition certain plasmids may also contain a centromeric sequence. These centromeric plasmids are generally a single or low copy plasmid. Plasmids without a centromeric sequence and utilizing either a 2 micron (*S. cerevisiae*) or 1.6 micron (*K. lactis*) replication origin are high copy plasmids. The selectable marker can be either prototrophic, such as HIS3, TRP1, LEU2, URA3 or ADE2, or antibiotic resistance, such as, bar, ble, hph, or kan.

In another embodiment, heterologous control elements can be used to activate or repress expression of endogenous genes. Additionally, when expression is to be repressed or eliminated, the gene for the relevant enzyme, protein or RNA can be eliminated by known deletion techniques.

As described herein, any yeast within the scope of the disclosure can be identified by selection techniques specific to the particular polypeptide (e.g. an isobutanol pathway enzyme) being expressed, over-expressed or repressed. Methods of identifying the strains with the desired phenotype are well known to those skilled in the art. Such methods include, without limitation, PCR, RT-PCR, and nucleic acid hybridization techniques such as Northern and Southern analysis, altered growth capabilities on a particular substrate or in the presence of a particular substrate, a chemical compound, a selection agent and the like. In some cases, immunohistochemistry and biochemical techniques can be used to determine if a cell contains a particular nucleic acid by detecting the expression of the encoded polypeptide. For example, an antibody having specificity for an encoded enzyme can be used to determine whether or not a particular yeast cell contains that encoded enzyme. Further, biochemical techniques can be used to determine if a cell contains a particular nucleic acid molecule encoding an enzymatic polypeptide by detecting a product produced as a result of the expression of the enzymatic polypeptide. For example, transforming a cell with a vector encoding acetolactate synthase and detecting increased acetolactate concentrations compared to a cell without the vector indicates that the vector is both present and that the gene product is active. Methods for detecting specific enzymatic activities or the presence of particular products are well known to those skilled in the art. For example, the presence of acetolactate can be determined as described by Hugenholtz and Starrenburg, 1992, *Appl. Micro. Biot.* 38:17-22.

Increase of Enzymatic Activity

Yeast microorganisms of the invention may be further engineered to have increased activity of enzymes (e.g., increased activity of enzymes involved in an isobutanol producing metabolic pathway). The term "increased" as used herein with respect to a particular enzymatic activity refers to a higher level of enzymatic activity than that measured in a comparable yeast cell of the same species. For example, overexpression of a specific enzyme can lead to an increased level of activity in the cells for that enzyme. Increased activities for enzymes involved in glycolysis or the isobutanol pathway would result in increased productivity and yield of isobutanol.

Methods to increase enzymatic activity are known to those skilled in the art. Such techniques may include increasing the expression of the enzyme by increased copy number and/or use of a strong promoter, introduction of mutations to relieve negative regulation of the enzyme, introduction of specific mutations to increase specific activity and/or decrease the $K_M$ for the substrate, or by directed evolution. See, e.g., Methods in Molecular Biology (vol. 231), ed. Arnold and Georgiou, Humana Press (2003).

Methods of Using Recombinant Microorganisms for Isobutanol Production

In another aspect, the present invention provides methods of producing isobutanol using a recombinant microorganism as described herein. In one embodiment, the method includes cultivating the recombinant microorganism in a culture medium containing a feedstock providing the carbon source until a recoverable quantity of isobutanol is produced and optionally, recovering the isobutanol. As described herein, said recombinant microorganism comprises an isobutanol producing metabolic and may be engineered to reduce or eliminate the expression or activity of one or more endogenous transporter proteins.

In a method to produce isobutanol from a carbon source, the recombinant microorganism is cultured in an appropriate culture medium containing a carbon source. In certain embodiments, the method further includes isolating the beneficial metabolite from the culture medium. For example, isobutanol may be isolated from the culture medium by any method known to those skilled in the art, such as distillation, pervaporation, or liquid-liquid extraction.

In one embodiment, the recombinant microorganism may produce isobutanol from a carbon source at a yield of at least 5 percent theoretical. In another embodiment, the microorganism may produce isobutanol from a carbon source at a yield of at least about 10 percent, at least about 15 percent, about least about 20 percent, at least about 25 percent, at least about 30 percent, at least about 35 percent, at least about 40 percent, at least about 45 percent, at least about 50 percent, at least about 55 percent, at least about 60 percent, at least about 65 percent, at least about 70 percent, at least about 75 percent, at least about 80 percent, at least about 85 percent, at least about 90 percent, at least about 95 percent, or at least about 97.5% theoretical.

This invention is further illustrated by the following examples that should not be construed as limiting. The contents of all references, patents, and published patent applica-

Example 1

Effect of Transporter Modifications in Yeast

The purpose of this example is to show the effect of transporter modifications in strains of S. cerevisiae comprising a native isobutanol-producing metabolic pathway.

Materials and Methods for Example 1

TABLE 2

Strains Used in Example 1.

| Strain | Genotype | Source |
|---|---|---|
| BY4741 Δaqr1 | MATa his3Δ1 leu2Δ0 met15Δ0 ura3Δ0 aqr1Δ0::KAN$^r$ | ResGen/Invitrogen Belgium |
| BY4741 Δpdr12 | MATa his3Δ1 leu2Δ0 met15Δ0 ura3Δ0 pdr12Δ0::KAN$^r$ | ResGen/Invitrogen Belgium |
| BY4741 Δopt1 | MATa his3Δ1 leu2Δ0 met15Δ0 ura3Δ0 opt1Δ0::KAN$^r$ | ResGen/Invitrogen Belgium |
| BY4741 Δadp1 | MATa his3Δ1 leu2Δ0 met15Δ0 ura3Δ0 adp1Δ0::KAN$^r$ | ResGen/Invitrogen Belgium |
| BY4741 Δaus1 | MATa his3Δ1 leu2Δ0 met15Δ0 ura3Δ0 aus1Δ0::KAN$^r$ | ResGen/Invitrogen Belgium |
| BY4741 Δtpo1 | MATa his3Δ1 leu2Δ0 met15Δ0 ura3Δ0 tpo1Δ0::KAN$^r$ | ResGen/Invitrogen Belgium |
| BY4741 Δtpo4 | MATa his3Δ1 leu2Δ0 met15Δ0 ura3Δ0 tpo4Δ0::KAN$^r$ | ResGen/Invitrogen Belgium |
| BY4741 Δpdr10 | MATa his3Δ1 leu2Δ0 met15Δ0 ura3Δ0 pdr10Δ0::KAN$^r$ | ResGen/Invitrogen Belgium |
| BY4741 Δsnq2 | MATa his3Δ1 leu2Δ0 met15Δ0 ura3Δ0 snq2Δ0::KAN$^r$ | ResGen/Invitrogen Belgium |
| BY4741 Δqdr2 | MATa his3Δ1 leu2Δ0 met15Δ0 ura3Δ0 qdr2Δ0::KAN$^r$ | ResGen/Invitrogen Belgium |
| BY4741 (wt) | MATa his3Δ1 leu2Δ0 met15Δ0 ura3Δ0 | ResGen/Invitrogen Belgium |

Fermentations:

Yeast precultures were shaken overnight at 30° C. in test tubes with 5 ml of 8% YPD medium. After 16 h of growth, 1 ml of the overnight culture was used to inoculate 50 ml of 8% YPD medium in 250 ml Erlenmeyer flasks, and this second preculture was shaken at 30° C. until stationary growth phase was reached. Cells were washed with sterile, distilled water, and used to inoculate 350 ml of fresh, prewarmed (20° C.) 12% YPD medium. Yeast strains were inoculated at 5 million cells per ml. Static fermentation was carried out at 20° C. in flasks with water locks placed on top, in order to create semi-anaerobic conditions mimicking full-scale fermentations. Samples for chromatographic analysis were taken when fermentation was completed and immediately cooled on ice in an airtight container.

Analysis of Diacetyl and Isobutanol:

Headspace gas chromatography (HS-GC) coupled with flame ionization detection (GC-FID) was used for the measurement of diacetyl and isobutanol. Fermentation samples were cooled on ice, centrifuged and filtered, after which 5 ml was collected in vials, which were immediately closed. Before analysis, the samples were heated at 60° C. for 1 h to cause complete conversion of α-acetolactate into diacetyl. Samples were then analyzed with a calibrated Autosystem XL gas chromatograph with a headspace sampler (HS40; Perkin-Elmer, Wellesley, Mass., USA) and equipped with a CP-Wax 52 CB column (length, 50 m; internal diameter, 0.32 mm; layer thickness, 1.2 µm; Chrompack, Varian, Palo Alto, Calif., USA). Samples were heated for 25 min at 70° C. in the headspace autosampler before injection (needle temperature: 105° C.). Helium was used as the carrier gas. The oven temperature was held at 50° C. for 5 min, then increased to 200° C. at a rate of 5° C. per min and finally held at 200° C. for 3 min. The FID and ECD temperatures were kept constant at 250° C. and 200° C., respectively. Analyses were carried out in duplicate, and the results were analyzed with Perkin-Elmer Turbochrom Navigator software. To determine the end values of isobutanol, the results were recalculated to 5% (v/v) ethanol to normalize.

Figure 2:
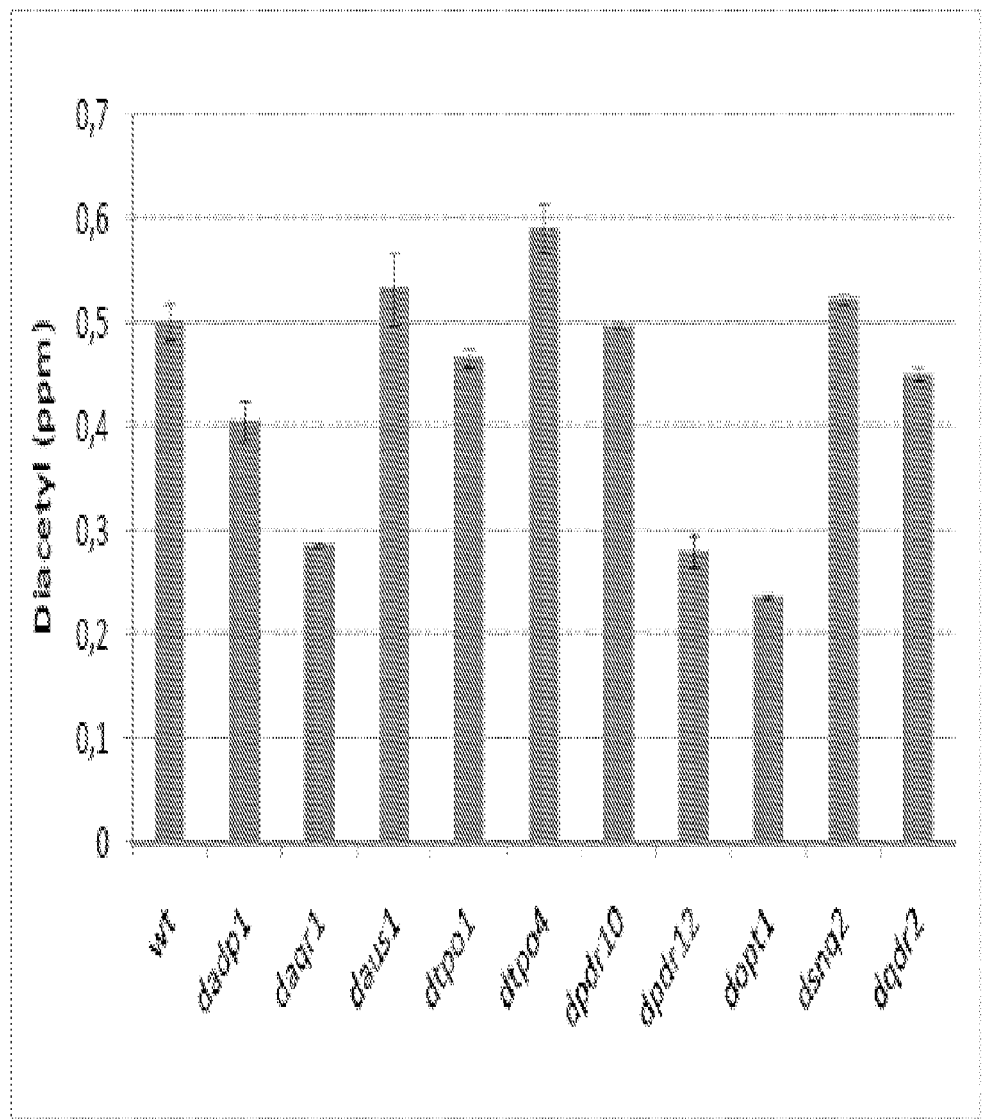
FIG. 2 illustrates the diacetyl fermentation results in *S. cerevisiae* strains engineered to reduce the expression of various transporter proteins.

Production of Diacetyl in the Transporter Mutants:

Transporters were inactivated by inserting the kanamycin resistance gene. Fermentations with the transporter mutants and with a wild-type strain as reference were set up as described in the materials and methods. At the end of the fermentation, diacetyl concentrations were measured. The measurement of diacetyl formation is important in the context of an isobutanol production pathway as diacetyl and is formed by the spontaneous oxidative decarboxylation of acetolactate outside the cell. In isobutanol producing yeast, diacetyl is an important by-product, because part of the acetolactate is exported to the medium. If acetolactate transport is blocked, the production of the diacetyl should be reduced. The results for diacetyl production in the transporter mutants are summarized in FIG. 2. As FIG. 2 illustrates, a decrease in diacetyl production was measured in several mutants. The decrease was most pronounced in deletions of Aqr1p, Pdr12p, Opt1p, Adp1p, and Qdr2p.

Figure 3:
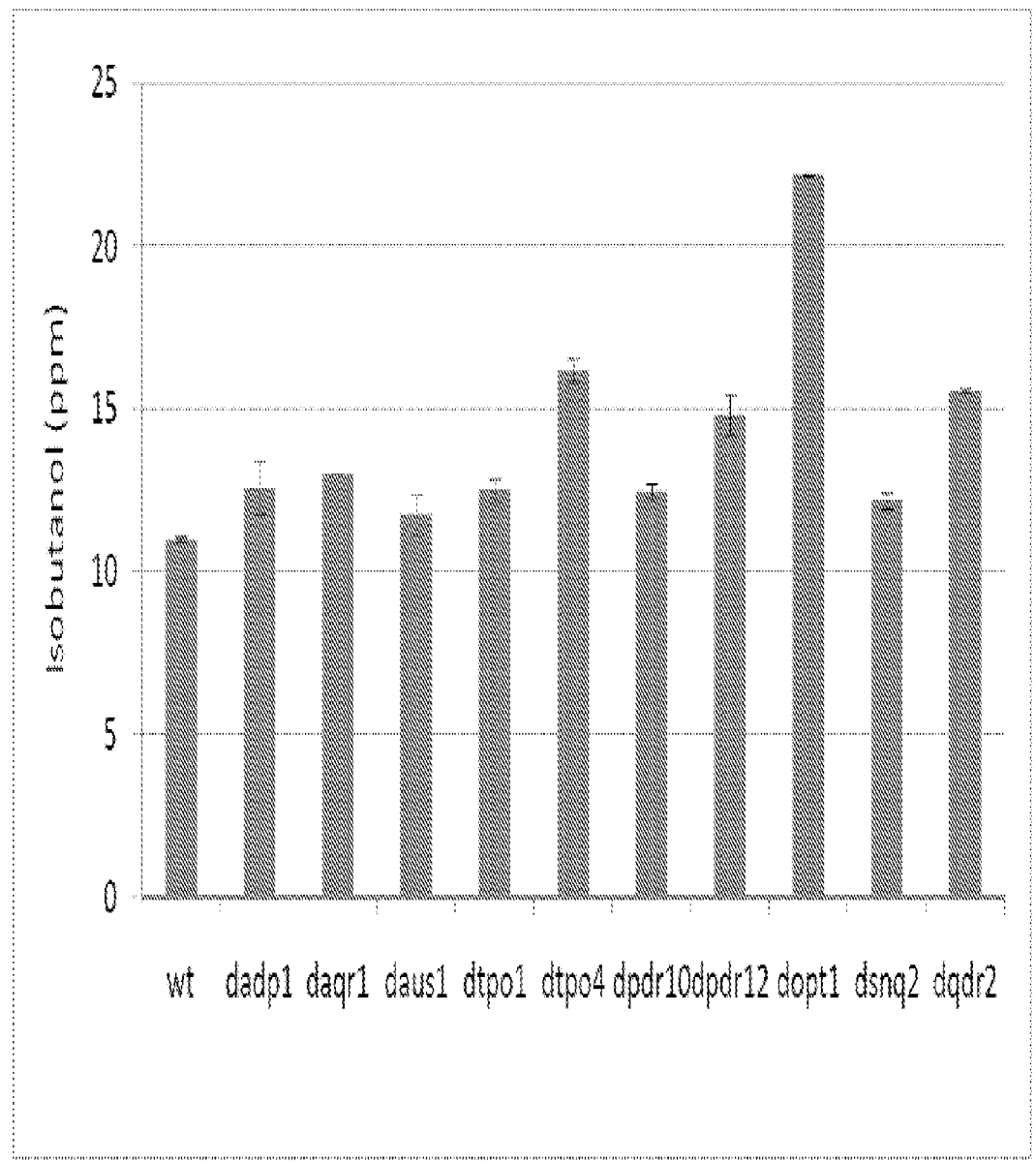
FIG. 3 illustrates the isobutanol fermentation results in *S. cerevisiae* strains engineered to reduce the expression of various transporter proteins.

Production of Isobutanol in the Transporter Mutants:

The results for isobutanol are summarized in FIG. 3. As the results in FIG. 3 illustrate, significant increases in isobutanol production were observed in S. cerevisiae strains engineered to reduce endogenous transporter expression. Strains showing the greatest improvement included those with reduced endogenous expression of Adp1p, Aqr1p, Tpo1p, Tpo4p, Pdr10p, Pdr12p, Opt1p, Snq2p, or Qdr2p.

Example 2

Effect of Transporter Modifications in Yeast

The purpose of this example is to show the effect of transporter modifications in strains of S. cerevisiae comprising an exogenous isobutanol-producing metabolic pathway.

Materials and Methods for Example 2

TABLE 3

Strains Used in Example 2.

| Strain | Genotype |
|---|---|
| GEVO3751 | MATa ura3 leu2 his3 trp1 gpd1Δ::$T_{KI\_URA3}$ gpd2Δ::$T_{KI\_URA3}$ tma29Δ::$T_{KI\_URA3}$_short-$P_{FBA1}$-KI_URA3-$T_{KI\_URA3}$ pdc1Δ::$P_{PDC1}$: Ll_kivD2_coSc5: $P_{FBA1}$: LEU2: $T_{LEU2}$: $P_{ADH1}$: Bs_alsS1_coSc: $T_{CYC1}$: $P_{PGK1}$L: Ll_kivD2_coEc: $P_{ENO2}$: Sp_HIS5 pdc5Δ::$_{TKI\_URA3}$ |

TABLE 3-continued

Strains Used in Example 2.

| Strain | Genotype |
|---|---|
| | pdc6Δ::P$_{TEF1}$: Ll_ilvD_coSc: P$_{TDH3}$: Ec_ilvC_coSc$^{P2D1-A1}$: P$_{ENO2}$: Ll_adhA: P$_{FBA1}$: Sc_TRP1 {evolved for C2 supplement-independence, glucose tolerance and faster growth} [Strain comprises the B. subtilis alsS (ALS), an E. coli ilvC variant (NADH-dependent KARI), a L. lactis ilvD (DHAD), a L. lactis kivD (KIVD), and an L. lactis adhA (NADH-dependent ADH)]. |
| GEVO6066 | GEVO3751 opt1Δ |
| GEVO6067 | GEVO3751 pdr12Δ |
| GEVO6068 | GEVO3751 aqr1Δ |
| GEVO6070 | GEVO3751 opt1Δ pdr12Δ |
| GEVO6071 | GEVO3751 opt1Δ aqr1Δ |
| GEVO6072 | GEVO3751 pdr12Δ aqr1Δ |
| GEVO6116 | GEVO3751 opt1Δ pdr12Δ aqr1Δ (ΔΔΔ) |

In this example, single, double, and triple deletions of OPT1, PDR12, and AQR1 were made in GEVO3751 (Table 3), a strain of S. cerevisiae expressing an exogenous isobutanol producing metabolic pathway. The deletion of OPT1, PDR12, and/or AQR1 did not significantly alter the production of biomass or the amount of glucose consumed during fermentation. The impacts on diacetyl, acetoin, 2,3-butanediol, and isobutanol production are described below.

Figure 4:
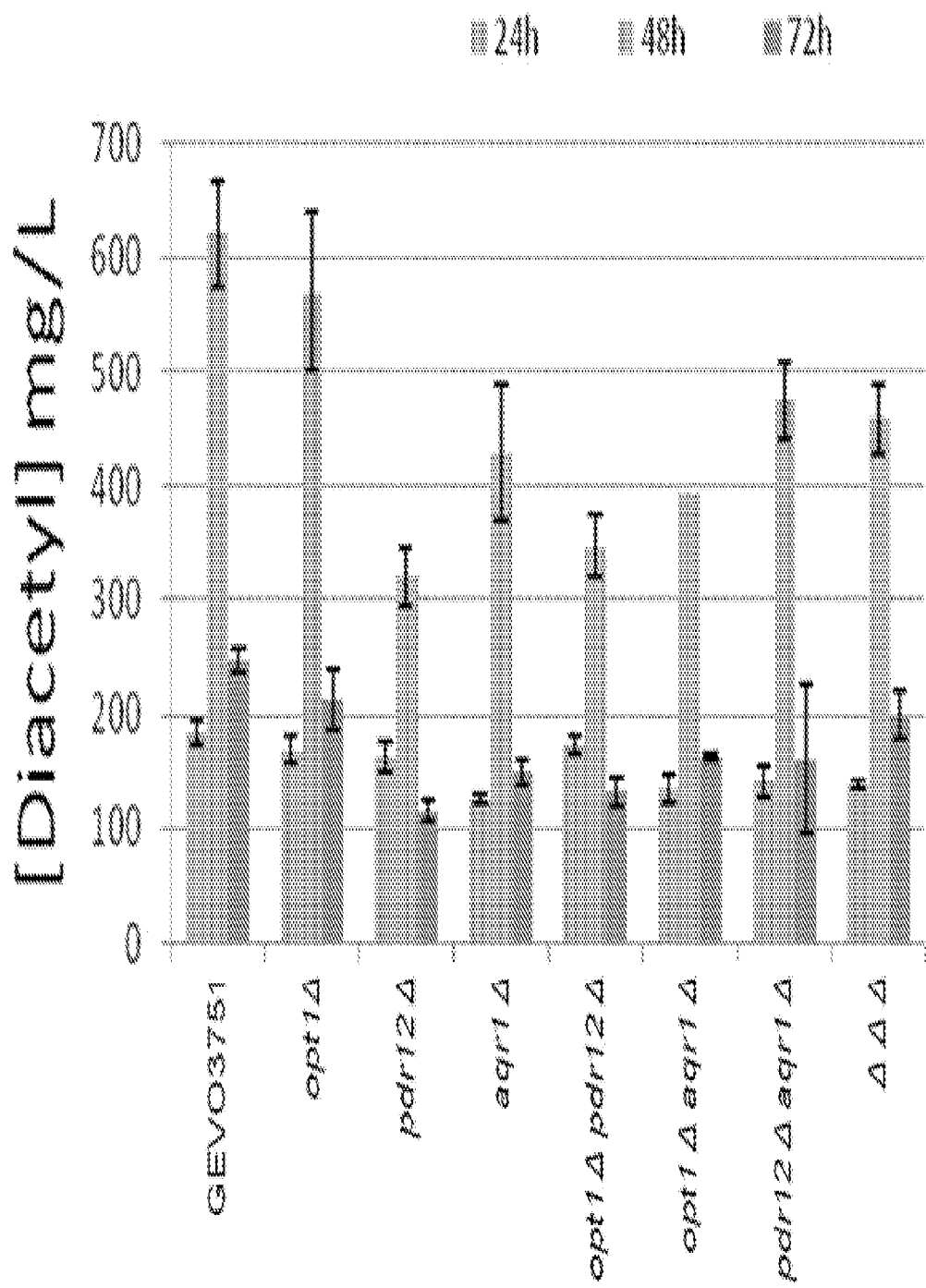
FIG. 4 illustrates the diacetyl fermentation results in *S. cerevisiae* strains comprising an exogenous isobutanol producing metabolic pathway that have been engineered to reduce the expression of various transporter proteins.

Diacetyl Production:

As described above in Example 1, the measurement of diacetyl formation is important in the context of an isobutanol production pathway as diacetyl and is formed by the spontaneous oxidative decarboxylation of acetolactate outside the cell. The impact of the single, double, and triple deletions in the GEVO3751 background on the production of diacetyl is shown in FIG. 4. As FIG. 4 illustrates, the pdr12Δ and aqr1Δ strains produced significantly less diacetyl than the GEVO3751 strain, while the effect in the opt1Δ strain was less pronounced.

Figure 5:
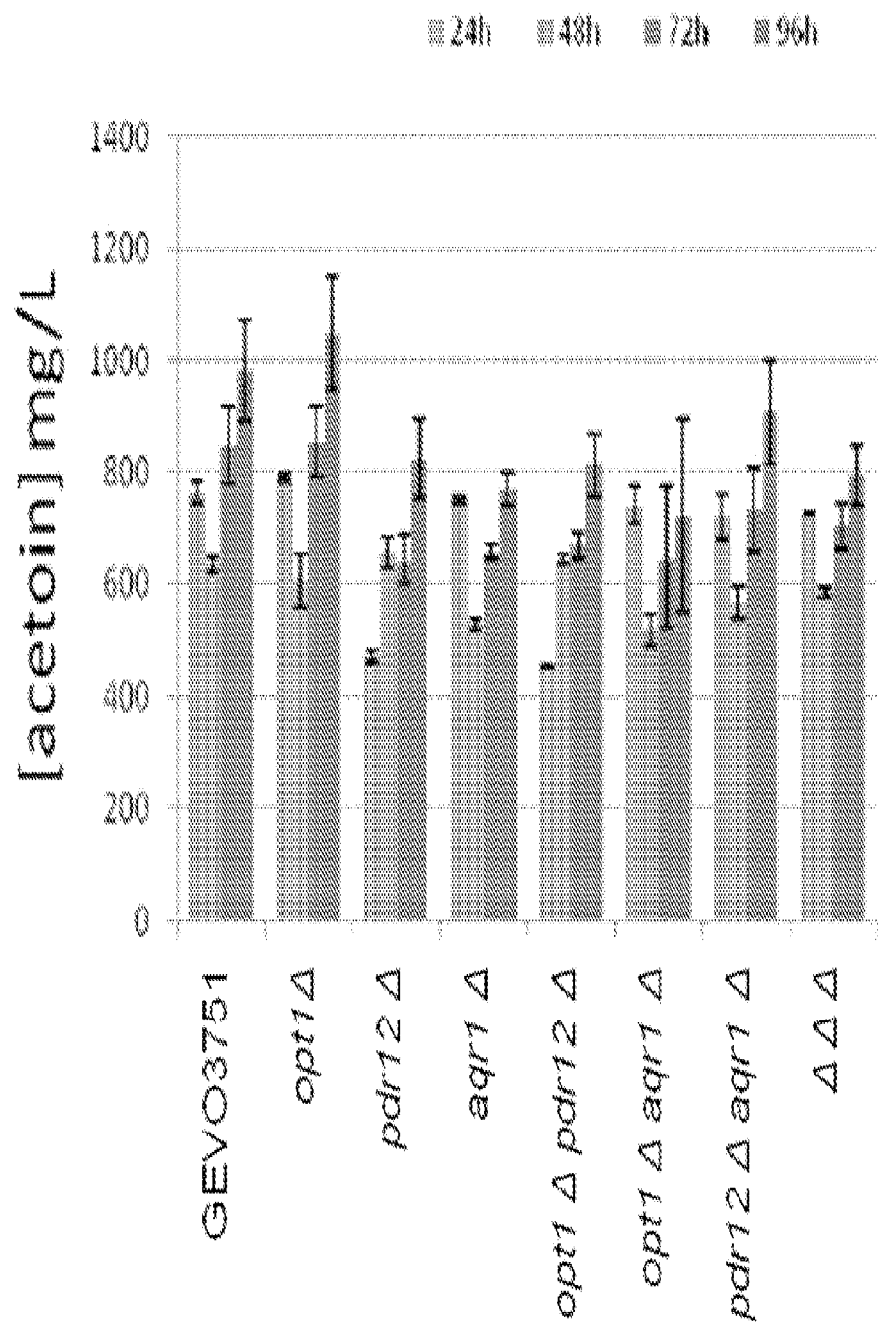
FIG. 5 illustrates the acetoin fermentation results in *S. cerevisiae* strains comprising an exogenous isobutanol producing metabolic pathway that have been engineered to reduce the expression of various transporter proteins.
Figure 6:
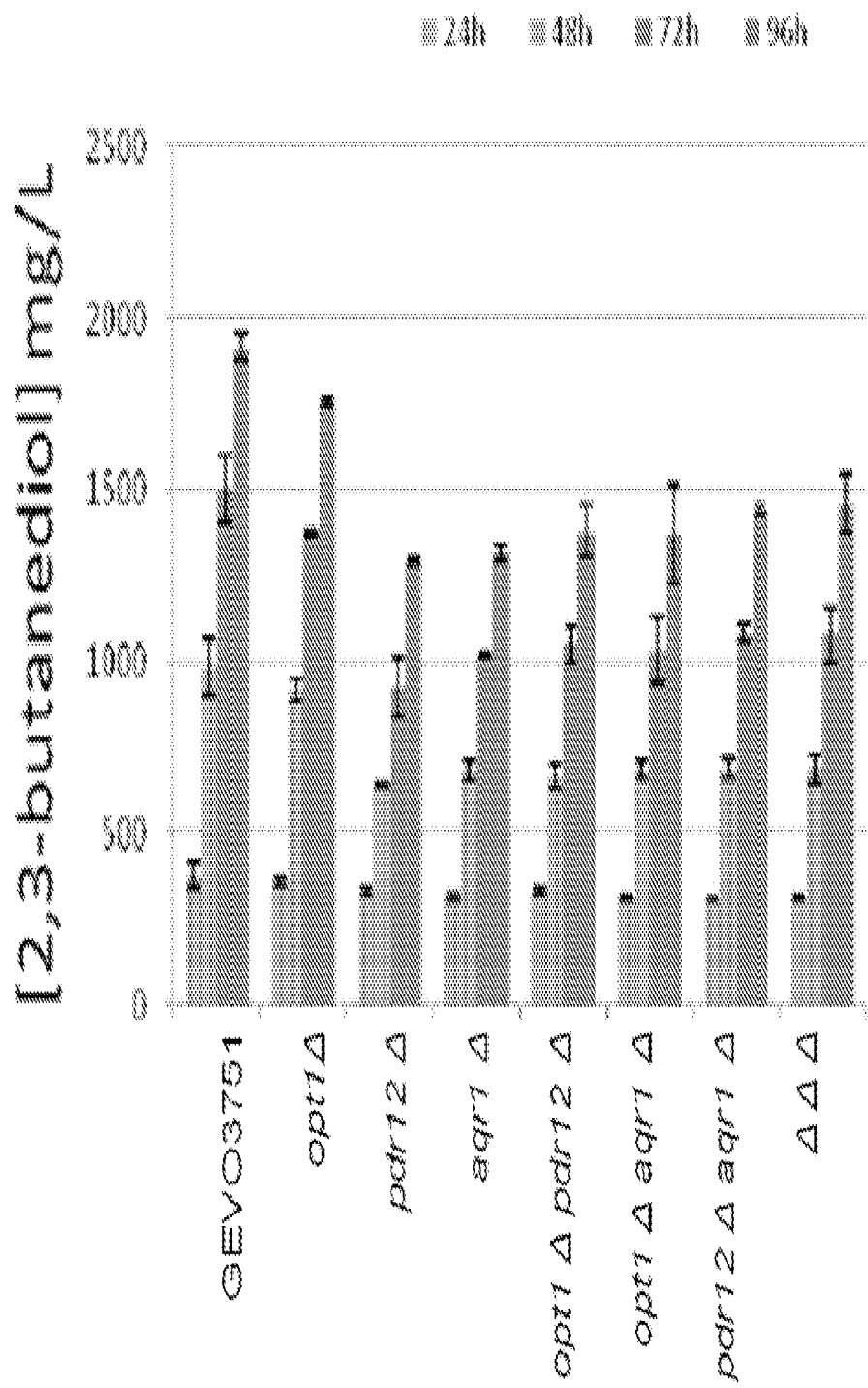
FIG. 6 illustrates the 2,3-butanediol fermentation results in *S. cerevisiae* strains comprising an exogenous isobutanol producing metabolic pathway that have been engineered to reduce the expression of various transporter proteins

Acetoin and 2,3-Butanediol Production:

In addition to measuring diacetyl formation, acetoin and 2,3-butanediol concentrations were also analyzed. These compounds are the reduction products of diacetyl. Thus, if acetolactate transport is blocked, the concentrations of acetoin and 2,3-butanediol are expected to decrease. The impact of the single, double, and triple deletions in the GEVO3751 background on the production of acetoin is shown in FIGS. 5 and 6, respectively. Similar to the results observed with diacetyl concentrations, the pdr12Δ and aqr1Δ strains produced significantly less acetoin than the GEVO3751 strain, while no significant effect in the opt1Δ strain was observed. With respect to 2,3-butanediol production, a significant decrease in the production of this by-product was seen at 96 h in pdr12Δ, aqr1Δ, and opt1Δ strains.

Figure 7:
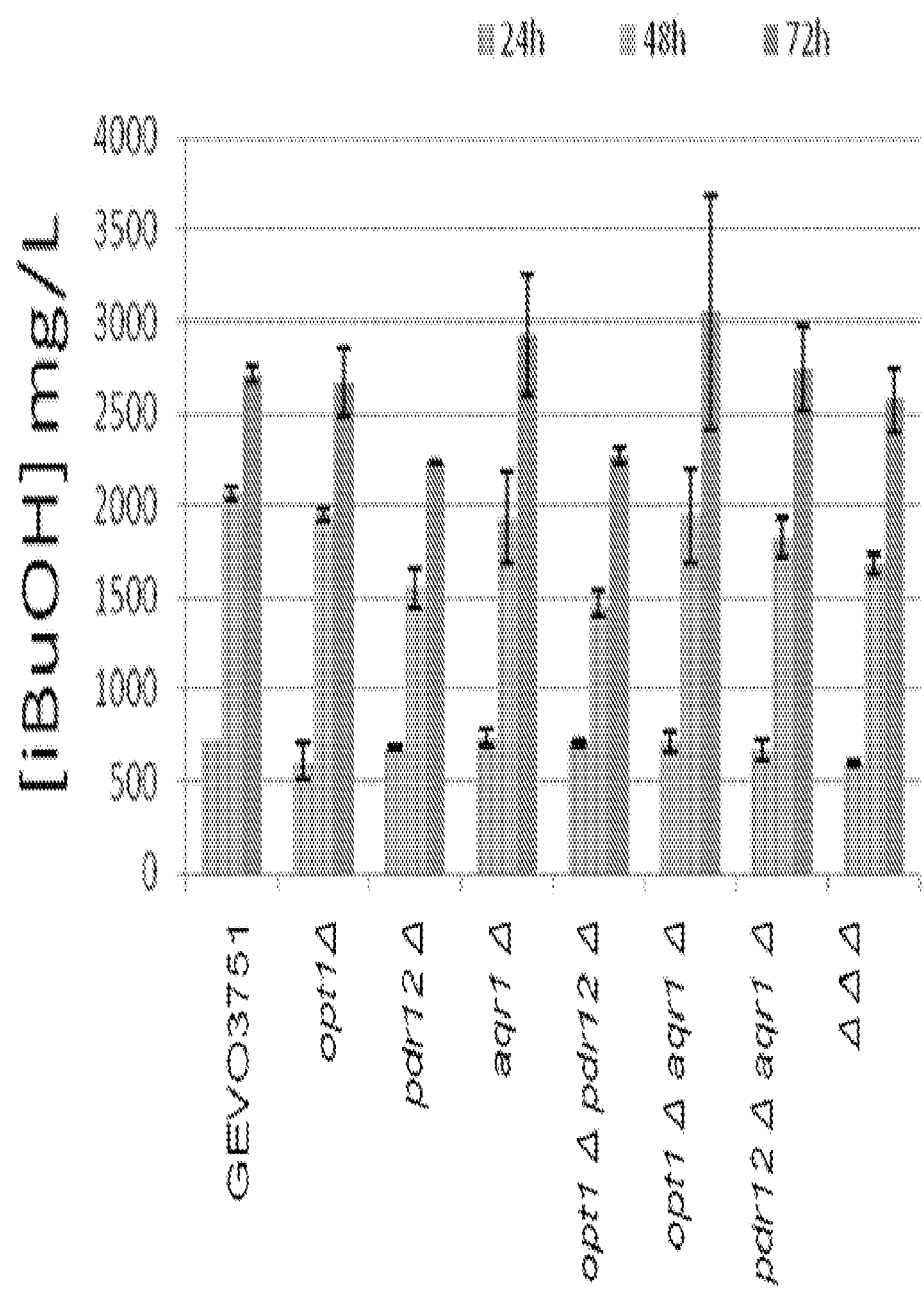
FIG. 7 illustrates the isobutanol fermentation results in *S. cerevisiae* strains comprising an exogenous isobutanol producing metabolic pathway that have been engineered to reduce the expression of various transporter proteins.

Isobutanol Production:

The impact of the single, double, and triple deletions in GEVO3751 background on the production of isobutanol is shown in FIG. 7. As FIG. 7 illustrates, strains comprising AQR1 and/or OPT1 deletions appeared to produce more isobutanol after 72 h of fermentation.

Example 3

Deletion of WAR1 in Yeast

In this example, deletion of WAR1 was made in GEVO6944 (Table 5), a S. cerevisiae expressing an exogenous isobutanol producing metabolic pathway. The deletion of WAR1 was achieved by introducing PCR generated DNA fragments encoding a transcriptional unit conferring resistance to the antibiotic hygromycin and containing homology to the sequence immediately upstream and downstream of the WAR1 open reading frame (50 nucleotides each). Transformants were selected for on appropriate plates and verified by PCR.

Media:

YPD: 20 g/L dextrose, 10 g/L yeast extract, and 20 g/L peptone. Ethanol and glycerol were added as indicated. MES was added to 200 mM and pH 6.5. Hygromycin was added at 0.10 g/L. Plates with the above media were made with 20 g/L agar.

TABLE 4

Plasmids Used in Example 3.

| No. | Plasmid Genotype |
|---|---|
| pGV2785 | pUC-ori, bla, loxP: P$_{Sc\_TPI1}$: hph: T$_{Sc\_CYC1}$: loxP |
| pGV2964 | 2μ P$_{Sc\_TEF1}$: Ll_ilvD: P$_{Sc\_TDH3}$: Ec_ilvC_coSc$^{P2D1-A1-his6}$: P$_{Sc\_TPI1}$: G418$^R$: P$_{Sc\_ENO2}$: Ll_adhA$^{RE1}$: T$_{Sc\_CYC1}$ |

TABLE 5

Yeast Strain Used in Example 3.

| No. | Genotype |
|---|---|
| 6944 | MATa ura3Δ bdh2/1Δ::P$_{Sc\_TEF1}$: ble: T$_{Sc\_CYC1}$ tma29::loxP pdc5::T$_{Kl\_LAC4}$ ald6::P$_{Sc\_PGK1}$: Bs_alsS1_coSc: T$_{Sc\_CYC1}$: P$_{Sc\_PGK1}$: Kl_URA3: T$_{Sc\_CYC1}$: P$_{Sc\_CCW12}$: Ec_ilvC_coSc$^{P2D1-A1-his6}$ gpd2::P$_{Sc\_PDC1(-628)}$: Ll_ilvD_coSc4: P$_{Sc\_TDH3}$: Sc_AFT1: T$_{Sc\_CYC1}$: loxP: P$_{Sc\_CCW12}$: Ec_ilvC_$^{coScP2D1-A1-his6}$ gpd1::P$_{Sc\_ADH1}$: Bs_alsS1_coSc: T$_{Sc\_CYC1}$: P$_{Sc\_PDC1(-750)}$: Ll_kivD_coSc5: T$_{Sc\_GPD1}$ pdc1::P$_{Sc\_CUP1}$: Bs_alsS1_coSc: T$_{Sc\_CYC1}$: P$_{Sc\_PGK1}$: Ll_kivD2_coEc: T$_{Kl\_URA3}$ pdc6::P$_{Sc\_TEF1}$: Ll_ilvD: P$_{Sc\_TDH3}$: Ec_ilvC_coSc$^{P2D1-A1-his6}$: P$_{Sc\_ENO2}$: Ll_adhA Transformed with pGV2964 and evolved for C2i, glucose derepression and ~0.1 h-1 growth rate in YNB50D medium |

PCR of Transformation Fragments:

Using the FailSafe™ PCR System (EPICENTRE® Biotechnologies, Madison, Wis.; Catalog #FS99250), diluted plasmid DNA (pGV2785) was used as template to amplify the hygromycin resistance marker gene fragment with flanking sequences homologous to the regions immediately upstream and downstream of the WAR1 open reading from in the genome of S. cerevisiae. Each PCR reaction mix contained 25 µL 2× FailSafe™ Master Mix E, 16.2 µL water, 3 µL of each primer (10 µM each), 0.8 µL of FailSafe™ PCR Enzyme, 2 µL of diluted pGV2785. The PCR reactions were incubated in a thermocycler using the following PCR conditions: 1 cycle of 94° C.×2 min, 30 cycles of 94° C.×30 s, 52° C.×20 s, 72° C.×2 min and 1 cycle of 72° C.×10 min.

Yeast Transformations:

GEVO6944 was transformed with the PCR-amplified DNA fragments following a standard yeast transformation protocol. Briefly, GEVO6944 cells were scraped off of an YPD plate with a sterile pipette tip into 3 mL YPD+200 mM MES pH 6.5+1% (v/v) ethanol+0.2 g/L G418. The cultures were incubated at 250 RPM, 30° C. overnight prior to the entire contents being poured into 50 mL of the same medium in a 250 mL baffled flask. The cultures were incubated at 250 RPM, 30° C. for 24 h, reaching an optical density ($OD_{600}$) of approximately 2. The cells were collected by centrifugation at 1600×g for 2 minutes in a sterile 50 mL tube. The supernatant was discarded, the cell pellet was resuspended in 50 mL sterile water, and the cells were collected by centrifugation at 1600×g for 2 minutes. The cell pellet was resuspended in 25 mL sterile water, and the cells were collected by centrifugation at 1600×g for 2 minutes. The cell pellet was resuspended in 1 ml 100 mM LiOAc and transferred into an eppendorf tube, followed by centrifugation in a microcentrifuge for 10 seconds at 14,000 rpm. The supernatant was removed and the cell pellet was resuspended with 4 times pellet volume of 100 mM lithium acetate (cell suspension). A DNA mix for each transformation was prepared with 7.5 µL each of two overlapping PCR fragments (15 µL total), 72 µL 50% PEG (MW 3350), 10 µL 1 M lithium acetate, 3 µL denatured salmon sperm DNA. To each DNA mix, 15 µL of the cell suspension was added in 1.5 mL tubes. The transformations were incubated at 30° C. for 30 minutes, and then heat-shocked at 42° C. for 22 minutes. The cells were diluted with 0.4 mL YPD+200 mM MES pH 6.5+1% (v/v) ethanol+0.2 g/L G418, and the cell cultures were incubated at 30° C., 250 RPM overnight prior to spreading the cells on YPD+G418+hygromycin to select for transformants by incubation at 30° C. for 2-3 days prior to their single colony purification on selection plates and screening by PCR.

Example 4

Effect of WAR1 Deletion in Yeast

The purpose of this example is to show the effect of deletion of the weak acid resistance transcription factor, WAR1, in strains of S. cerevisiae comprising an exogenous isobutanol-producing metabolic pathway. Production of acetolactate, diacetyl, acetoin, 2,3-butanediol, and isobutanol by the war1Δ deletion strain is assessed in a shake flask fermentation experiment Media:

YPD: 20 g/L dextrose, 10 g/L yeast extract, and 20 g/L peptone. Ethanol and dextrose are added as indicated. Agar is added at 20 g/L. Citrate/phosphate buffered YP media (filter-sterilized) at pH 5: 500 mL 2×YP solution (20 g/L yeast extract and 40 g/L peptone), 80 g/L dextrose, 243 mL 0.1 M citric acid, 257 mL 0.2 M $K_2HPO_4$m pH adjusted with 4M $H_2SO_4$.

Shake Flask Fermentation:

A shake flask fermentation with the war1Δ deletion strain described in Example 3 is performed to assess production of acetolactate, diacetyl, acetoin, 2,3-butanediol, and isobutanol. Briefly, patched cells grown on appropriate plates at 30° are mixed into 3 mL YP+8% dextrose+200 mM MES pH 6.5+1% (v/v) ethanol in 15 mL culture tubes and incubated at 250 RPM, 30° C. overnight. The cells from the cultures are used to inoculate 50 mL YP+8% dextrose+Citrate/Phosphate Buffer pH 5+1% (v/v) ethanol in non-baffled flasks at $OD_{600}$~0.1. The cultures are incubated at 250 RPM, 30° C. for 28 hours and then the agitation speed is decreased to 75 RPM. Samples (1.5 mL) are removed from the cultures (time=0) prior to incubation at 75 RPM, 30° C. for 48 hours. Samples are also removed after 24 h and 51 h incubation. Samples are processed after determination of the optical densities ($OD_{600}$) of the cultures by centrifugation at 18,000×g, 10 minutes. The supernatants are transferred to fresh tubes, and 500 µL of each sample is transferred to a separate tube containing 500 µL 1M Tris pH8. The samples are stored at 4° C. The concentrations of acetolactate, diacetyl, acetoin, 2,3-butanediol, and isobutanol are determined by gas and high-pressure liquid chromatography (Methods GC1, GC10, LC3, and LC4). The isobutanol concentration is generally expected to be higher in the war1Δ deletion strain as compared to the control strain, GEVO6944.

Gas Chromatography (GC1):

Analysis of volatile organic compounds, including ethanol and isobutanol is performed on an Agilent 6890 gas chromatograph (GC) fitted with a 7683B liquid autosampler, a split/splitless injector port, a ZB-FFAP column (Phenomenex 30 m length, 0.32 mm ID, 0.25 µM film thickness) connected to a flame ionization detector (FID). The temperature program is as follows: 230° C. for the injector, 300° C. for the detector, 100° C. oven for 1 minute, 35° C./minute gradient to 230° C., and then hold for 2.5 min. Analysis is performed using authentic standards (>98%, obtained from Sigma-Aldrich), and a 6-point calibration curve with 1-pentanol as the internal standard. Samples may be submitted in deep-well plates. Injection size is 0.5 µL with a 50:1 split and run time is 7.4 min.

Gas Chromatography (GC10):

Analysis of volatile organic compounds and their isomers, including R-acetoin, S-acetoin, R,R butanediol, S,S butanediol, and meso butanediol is performed on an Agilent 7890 gas chromatograph (GC) fitted with a 7683B liquid autosampler, a split/splitless injector port, a cyclosil B column (Agilent 30 m length, 0.25 mm ID, 0.25 µM film thickness) connected to a flame ionization detector (FID). The temperature program is as follows: 240° C. for the injector, 300° C. for the detector, 105° C. oven for 1 minute, 35° C./minute gradient to 230° C., and then hold or 2 min. Analysis is performed using authentic standards (>97% or highest purity available), and a 6-point calibration curve with 1-pentanol as the internal standard. Samples may be submitted in deep-well plates. Injection size is 0.5 µL with a 50:1 split and run time is 6.7 min.

High Performance Liquid Chromatography (LC1):

Analysis of organic acid was performed on an Agilent 1200 or equivalent High Performance Liquid Chromatography system equipped with a Bio-Rad Micro-guard Cation H Cartridge and two Phenomenex Rezex RFQ-Fast Fruit H+ (8%), 100×7.8-mm columns in series, or equivalent. Organic acid metabolites were detected using an Agilent 1100 or equivalent UV detector (210 nm) and a refractive index detector. The column temperature was 60° C. This method was isocratic with 0.0180 N H$_2$SO$_4$ in Milli-Q water as mobile phase. Flow was set to 1.1 mL/min. Injection volume was 20 μL and run time was 16 min. Quantitation of organic acid metabolites was performed using a 5-point calibration curve with authentic standards (>99% or highest purity available), with the exception of DHIV (2,3-dihydroxy-3-methyl-butanoate, CAS 1756-18-9), which was synthesized according to Cioffi et al. (Cioffi, E. et al. *Anal Biochem* 1980, 104, pp. 485) and DH2MB which quantified based on the assumption that DHIV and DH2MB exhibit the same response factor. In this method, DHIV and DH2MB co-elute, hence their concentrations are reported as the sum of the two concentrations.

High Performance Liquid Chromatography (LC3):

100 μL DNPH reagent (12 mM 2,4-Dinitrophenyl Hydrazine 10 mM Citric Acid pH 3.0 80% Acetonitrile 20% MilliQ H$_2$O) was added to 100 μL of each sample. Samples were incubated for 30 min at 70° C. in a thermo-cycler (Eppendorf, Mastercycler). Analysis of acetoin, diacetyl, ketoisovalerate and isobutyraldehyde was performed on an HP-1200 High Performance Liquid Chromatography system equipped with an Eclipse XDB C-18 150×4 mm; 5 μm particle size reverse phase column (Agilent) and a C-18 reverse phase guard column (Phenomenex). Ketoisovalerate and isobutyraldehyde were detected using an HP-1100 UV detector (360 nm). The column temperature was 50° C. This method was isocratic with 60% acetonitrile 2.5% phosphoric acid (4%), 37.5% water as mobile phase. Flow was set to 2 mL/min. Injection size was 10 μL and run time is 10 min.

High Performance Liquid Chromatography (LC4):

Analysis of oxo acids was performed on a HP-1100 High Performance Liquid Chromatography system equipped with an IonPac AS11-HC Analytical, IonPac AG11-HC guard column (3-4 mm for IonPac ATC column) or equivalent and an IonPac ATC-1 Anion Trap column or equivalent. Oxo acids were detected using a conductivity detector (ED50-suppressed conductivity, Suppressor type: ASRS 4 mm in Auto-Suppression recycle mode, Suppressor current: 300 mA). The column temperature was 35° C. This method used the following elution profile: 0.25 mM NaOH for 10 min, linear gradient to 3.5 mM NaOH at 25 min, linear gradient to 38.5 mM at 37 min, linear gradient to 0.25 mM at 37.1 min. Flow was set at 2 mL/min. Injection size is 5 μL. Analysis was performed using authentic standards (>99%), obtained from Sigma-Aldrich, with the exception of DHIV (2,3-dihydroxy-3-methyl-butanoate, CAS 1756-18-9), which was custom synthesized at Caltech (Cioffi, E. et al. Anal Biochem 104 pp. 485 (1980)) and racemic 2-hydroxy-2-methyl-3-oxobutyrate (acetolactate) which was made. by hydrolysis of Ethyl-2-acetoxy-2-methylacetoacetate (EAMMA) with NaOH (Krampitz, 1957), and a 5-point calibration curve.

The foregoing detailed description has been given for clearness of understanding only and no unnecessary limitations should be understood there from as modifications will be obvious to those skilled in the art.

While the invention has been described in connection with specific embodiments thereof, it will be understood that it is capable of further modifications and this application is intended to cover any variations, uses, or adaptations of the invention following, in general, the principles of the invention and including such departures from the present disclosure as come within known or customary practice within the art to which the invention pertains and as may be applied to the essential features hereinbefore set forth and as follows in the scope of the appended claims.

The disclosures, including the claims, figures and/or drawings, of each and every patent, patent application, and publication cited herein are hereby incorporated herein by reference in their entireties.

SEQUENCE LISTING (308 sequences)

SEQ ID NO: 1 - DNA, 2400 bp, Saccharomyces cerevisiae
atgagtaccatttatagggagagcgactcgttggagtcggagccctcgccaacgccaacaaccattcctatccagatcaatatggaagaggaaaagaaagatgctttcgttaagaatattgacgaggacgtcaataatctcactgcgactactgatgaggaggaccgcgatccggaaagccaaaaattcgacaggcattccatacaggaggaaggtctcgtttggaagggcgaccctacatacttgcccaattctccatatcctgaagtgagatcggcggtgtccatcgaggatgaccccaccatccgcctcaaccactggagaacgtggttcttgaccacggtgtttgtggtagttttcgccggtgttaatcaatttttttccctgagatatccatcgctagagatcaacttccttgttgcacaagttgtttgctacccaattggtaggatactggctctcttgcccgactggaagtgttctaaagtgccatttttcgatttaaacccgggcccatttaccaaaaaggaacacgccgtggtcacaattgccgtggcgcttacttcctctactgcatacgctatgtacattttgaacgcccagggaagcttttacaacatgaaacttaatgtcggatatcagttcttgttggtttggacatctcaaatgattggttatggtgctgcaggtcttaccagaagatgggtcgtcaaccctgcaagctctatctggcctcagactttaatttcagtgtccttgtttgattcgttgcactcgagaaaagttgaaaagacagtcgcaaatggttggacgatgccccgttacaggttcttcttaatcgtccttatcggatcgttcatctggtattgggtacctggattcctctttaccggtctgtcctatttcaacgttatcctatgggggtcgaagacaagacacaatttcatcgctaacacaatctttggtactcaaagtggtctcggtgcgttgccaattacatttgactacacccaggtttcccaagccatgtccggctctgttttcgccacaccattctacgtctccgccaacacctatgcatcagtgttgatattcttcgtcatagtgctgccatgtctttattttacgaatacctggtatgccaaatacatgcccgtcatttcaggttctacttatgacaacactcaaaacaaatacaacgtaacaaagattcttaacgaggattattccattaatcttgagaaatataaggaatactcaccggtattcgttccattttcctatcttttgtcgtatgctttaaattttgccgctgttatcgccgtttttgtccactgcatcttataccacggtaaagatattgtcgccaagtttaaagaccgtaaaaatggtggcactgacattcacatgagaatctactccaagaactataaggattgtcccgattggtggtatttacttttgcagattgtcatgatcggtttaggatttgtagcagtgtgctgtttcgatactaagttcccagcttgggcatttgttattgcaatattaatttcccttgtaaatttcatcccgcaaggtatcttggaagcaatgactaaccaacacgtaggtttgaatattatcacagaattgatctgcggttatatgctgcctttaagaccaatggcaaacttattattcaagctatacggatttattgtcatgagacaaggcttgaatttgagtagagatttgaaattagccatgtacatgaaggtttcccctcgtttgatctttgccgttcaaatctatgccactatcatatcaggcatggttaacgttggtgtccaggaatggatgatgcataatatcgatggcttatgtaccaccgatcaaccaaatggcttcacttgtgctaatggtcgcacggttttcaatgcttccattatctggtctttgccaaagtatcttttctcatcagggcgcatttataatccgctgatgtggttcttcttgattggtttgctattcccactagccgtttatgctgttcaatggaaattccctaaatttaaatttgctaagcacattcatactcctgtatttttcacaggcccaggtaatattccaccaagcacaccttataactactcattattttttgcaatgtcattctgcctaaacttgataagaaaaagatggagagcttggttcaataagtacaatttcgtcatgggggccggtgttgaagcaggtgtggcaatctccgtcgtcatcatcttcttgtgtgtacagtacccaggtggtaagctcagctggtggggaaacaacgtttggaaaagaacgtatgataatgattataaaaaattttataccttaaagaaaggtgagacatttggttatgataaatggtggtaa

SEQ ID NO: 2 - protein, 799 aa, Saccharomyces cerevisiae
MSTIYRESDSLESEPSPTPTTIPIQINMEEEKKDAFVKNIDEDVNNLTATTDEEDRDPESQKFDRHSIQEEGLVWKGDPTYLPNSPYPEVRSAVSIEDDPTIRLNHWRTWFLTTVFVVVFAGVNQFFSLRYPSLEINFLVAQVVCYPIGRILALLPDWKCSKVPFFDLNPGPFTKKEHAVVTIAVALTSSTAYAMYILNAQGSFYNMKLNVGYQFLLVWTSQMIGYGAAGLTRRWVVNPASSIWPQTLISVSLFDSLHSRKVEKTVANGWTMPRYRFFLIVLIGSFIWYWVPGFLFTGLSYFNVILWGSKTRHNFIANTIFGTQSGLGALPITFDYTQVSQAMSGSVFATPFYVSANTYASVLIFFVIVLPCLYFTNTWYAKYMPVISGSTYDNTQNKYNVTKILNEDYSINLEKYKEYSPVFVPFSYLLSYALNFAAVIAVFVHCILYHGKDIVAKFKDRKNGGTDIHMRIYSKNYKDCPDWWYLLLQIVMIGLGFVAVCCFDTKFPAWAFVIAILISLVNFIPQGILEAMTNQHVGLNIITELICGYMLPLRPMANLLFKLYGFIVMRQGLNLSRDLKLAMYMKVSPRLIFAVQIYATIISGMVNVGVQEWMMHNIDGLCTTDQPNGFTCANGRTVFNASIIWSLPKYLFSSGRIYNPLMWFFLIGLLFPLAVYAVQWKFPKFKFAKHIHTPVFFTGPGNIPPSTPYNYSLFFAMSFCLNLIRKRWRAWFNKYNFVMGAGVEAGVAISVVIIFLCVQYPGGKLSWWGNNVWKRTYDNDYKKFYTLKKGETFGYDKWW

SEQ ID NO: 3 - DNA, 2634 bp, Saccharomyces cerevisiae
atgagtgaaacagtcaaagataaagttataattgatgagaaggtatccacaaaaggtactgttgattacgccgagggtgctgagtattctgagaggctttcaaatcattcatcagacttttctcagtggtatacggatgaacagatactgcactttatgaagaagctgggttatgaaaatcgcactctttatgatattccggaagacgttgcgtatatcctcaaaaaaatgcctgaattgacacttgaggattccttcaaaatactaaaagactctatcatctatttcaaggatgatgagaacattccacacgatcaatatgaggagtggaagagattggttgacttggaggacttggattcaaaagaggggatagatgaatatgatagctttgacattagagcatttgcttctgctattaaatttcattcgccttaccaagaggttagagctgttgttgatccagaagatgatcccaccattccagtggagacattccgagcatattttctggcaataatttggtctgtcatcggttcaggatttaatgagtttttttcacacagggtggtttcaatttcactgaatactccaattatccaaatgtttttatatatctgtggtaaggcttgggctaaaactatcccctgttggactataaccatcaggggcagaaagtatggtatcaatatcgataaaccatggacccaaaaagagcaaatgttttcaaccttgttatatgcaatttgtcaaggcgcgttctatactcattacaatattctaacgcaaaaactcttttaccattctgctttctcgtttggctaccaatttttactttcgttatccgtacaatttattggatttggatttgctggcatccttagaaaattcgttgtttatccagcccgtgcactatggccaacagtcatgccaactattgctatcaacaaggcactattgggtaaagaaaagcatgaatctggaatgagcaggtataaattctttttcttgactttttttatcatgttcatctataactggtttcccacttacattattaatattctaaacactttcaattggatgacctggatcaagccaagtaacattaatctcgcaaacatcacgggaggagtcactggtcttgggattaatcctatctcatcttttgactggaatgttatttcgtttaattctcctttagtttacccattttggtcatacttaacacaatatcttggttgcatattagcagctttaattgttattgcagtatactatagtaattatatgagttgccaatacctgccaatattcacaaattctttgtatactaatactggccattcctttaaagttactgaggtattagacagtgacaataagctagatgtgaaaaaatatcaaagctactcgccaccatactatagtgctggaaatttggtatcatatggtgctttcatttgcgcatatcctctgatgattacatggtcgtttattgtacactcaaagttattgttcaatgctttcaaagattgggctttgaatttgtgggccatgagaaaacttaaatcttgggtcacaatgttcaaaagcgattacagggcgctcgacgattatgatgacccacattctaatgccatgaaaaactataaagaagttccagattggtggtattttgccatattgataggttcacttgttgttggaatagctgttgtagagcactacccaacaaatacaccagtttggggtctttttgtttgtttaggatttaattttgttttcttgattccaactactatccttcaagcaaccactggttattcgtttggtttgaatctactaattgaaatggtgatggggtacgctttaccaggtaatccaatcgccataatgattttgaaggcttttggttataacatcgacggccaagcagataattacgtttctaacttaaaaatagcgcattattgtaagattccgccaatggcgctattcaggggacaatgtgttatagttttcattcagatatttgtcaatctaggtgttctgaattggcaaatctccaatatcaaagacttttgcacacctcatcaaaacgcaaaattcacctgtcctgatgctgtgacctactataatgcttccgttgtctggggtgcaattgggccaaaaagaattttcaattacatttatccaatatttaaatggtgttggttgataggcgcatgcattggcatattttttggtgtttggaagcgctggggtaagttttatcccagatattttgacccaatgttatttgtaggtggaatgcttaatatgagccctccatataacctgatgtattacacttctggtatgattgttagttacatttcccagtactacatgaaaagacaccatttaaatctgtgggagaaatataattatgttttatcggcaggcttttcaacgggcttggttttatcagctattatcattttctttgctgtccaatataaagacacagcttttaattggtggggcaatacagttccgtatgctggtgccgatggcgttggctatcctctaaagaacataactgatacagcaaatggctatttcggctatgctccaggacactatccatga

SEQ ID NO: 4 - protein, 877 aa, Saccharomyces cerevisiae
MSETVKDKVIIDEKVSTKGTVDYAEGAEYSERLSNHSSDFSQWYTDEQILHFMKKLGYENRTLYDIPEDVAYILKKMPELTLEDSFKILKDSIIYFKDDENIPHDQYEEWKRLVDLEDLDSKEGIDEYDSFDIRAFASAIKFHSPYQEVRAVVDPEDDPTIPVETFRAYFLAIIWSVIGSGFNEFFSHRVVSISLNTPIIQMFLYICGKAWAKTIPCWTITIRGRKYGINIDKPWTQKEQMFSTLLYAICQGAFYTHYNILTQKLFYHSAFSFGYQFLLSLSVQFIGFGFAGILRKFVVYPARALWPTVMPTIAINKALLGKEKHESGMSRYKFFFLTFFIMFIYNWFPTYIINILNTFNWMTWIKPSNINLANITGGVTGLGINPISSFDWNVISFNSPLVYPFWSYLTQYLGCILAALIVIAVYYSNYMSCQYLPIFTNSLYTNTGHSFKVTEVLDSDNKLDVKKYQSYSPPYYSAGNLVSYGAFICAYPLMITWSFIVHSKLLFNAFKDWALNLWAMRKLKSWVTMFKSDYRALDDYDDPHSNAMKNYKEVPDWWYFAILIGSLVVGIAVVEHYPTNTPVWGLFVCLGFNFVFLIPTTILQATTGYSFGLNLLIEMVMGYALPGNPIAIMILKAFGYNIDGQADNYVSNLKIAHYCKIPPMALFRGQCVIVFIQIFVNLGVLNWQISNIKDFCTPHQNAKFTCPDAVTYYNASVVWGAIGPKRIFNYIYPIFKWCWLIGACIGIFFGVWKRWGKFYPRYFDPMLFVGGMLNMSPPYNLMYYTSGMIVSYISQYYMKRHHLNLWEKYNYVLSAGFSTGLVLSAIIIFFAVQYKDTAFNWWGNTVPYAGADGVGYPLKNITDTANGYFGYAPGHYP

SEQ ID NO: 5 - DNA, 3150 bp, Saccharomyces cerevisiae
atgggaagtcatcgacgttatctctactatagtatattatcatttctattattatcctgctcagtggtacttgcaaaacaagataagaccccattctttgaaggtacttcttcgaaaaattcgcgtctaactgcacaagataagggcaatgatacatgcccgccatgttttaattgtatgctacctatttttgaatgcaaacagttttctgaatgcaattcgtacactggtagatgtgagtgtatagaagggtttgcaggtgatgattgctctctgcccctctgtggcggtctatcaccggatgaaagcggtaataaggatcgtcccataagagcacaaaatgacacctgtcattgtgataacggatggggagggatcaattgtgacgtttgtcaagaagattttgtctgtgatgcgttcatgcctgatcctagtattaaggggacatgttataagaatggtatgattgtagataaagtattttcaggttgtaatgtgaccaatgagaaaattctacagattttgaacggcaaaataccacaaattacatttgcctgtgataaacctaatcaagaatgtaattttcagttttggatagatcagttagaaagcttctattgtggcttaagtgattgtgcctttgaatacgacttggaacagaatacctcccattataagtgtaatgacgttcaatgcaaatgcgttcccgacactgtgttgtgtggtgctaaggggtctatagatatctcggatttcctgacagagacaataaaagggccaggagatttcagctgtgatttagaaacaaggcaatgtaaattcagtgagccttctatgaatgatttgatattgaccgtgtttggtgacccttatattactttgaagtgtgaatccggtgaatgtgttcattatagtgagattccaggttacaaatctccttcaaaagatccaacagtgtcatggcaagggaaattggtgttggcattgactgctgtgatggtcctggcactttttacatttgctaccttttacatttctaaatctccgttattcagaaatggattgggttcctcaaagtctcccattcgtttgccagatgaagatgcggtgaataatttcttacaaaatgaagatgacacactggcgacattaagttttgaaaatatcacttatagtgtcccctcgataaattcagatggtgttgaagaaactgtgctgaatgaaataagtggtatcgtgaagcccggccaaatattagctatcatgggtggatctggtgcgggtaaaactactttattagatatcctagcaatgaaacggaaaacaggtcacgtttcgggttccataaaagttaacggtattagtatggaccgtaaatctttctcgaaaataatcgggttcgtcgatcaagatgactttttgctgcccactttgactgtttttgaaaccgtattaaatagtgcgctgttaagattgccaaaagcattgtcattcgaggccaagaaggcaagagtttataaggtgttggaagaactaagaattattgatatcaaagatcgtattattggtaatgaatttgatcgtggtattagtggaggtgaaaaacgccgagtttccattgcatgtgaattagtgacatctccattggttttatttttggatgaacctacatctggtttagatgctagtaatgccaataatgttattgaatgtttggtaaggttatccagcgactataacaggacattggtgctatctattcatcagccaagatcaaatatattttatttattcgataaattggtcctgttaagtaaaggtgagatggtctattccggaaatgccaaaaaagtgtcagaatttttgagaaatgagggatatatctgtccggacaactataatattgctgattatttgattgatattacttttgaagccggtcctcaggggaaaaggagaagaatcagaaacatttccgatttagaagctggtacggatactaacgatattgataatacgatacaccaaacaacatttactagcagtgatggtacaacacagagagagtgggctcatcttgcagctcatagagatgagatcagatctttactcagagatgaagaagatgtagagggaacagatggaaggcgaggtgctactgagattgacttaaataccaaactactacacgataaatataaagatagcgtctattatgcagagctttcacaggagatcgaggaagttttaagcgaaggtgatgaggaaagtaacgttttgaatggagatttacccacaggtcaacaatctgctggttttctgcaacagttatcgatattgaattcaagaagttttaaaaacatgtacagaaaccctaaactattattgggtaattatttactgacgatcctattgagtttattcttgggaacactatattacaacgtctccaatgatatcagcggttttcagaacagaatggggctgttcttctttatactaacgtacttcggttttgttacattcacaggtctcagctcgttcgctctggaaaggatcattttcataaaagaaagatccaataactattactcgccacttgcatactacattagtaagataatgagcgaagtggtcccgctacgtgttgtaccacctatactcttgtcattgattgtttacccaatgactggtttaaacatgaaagacaatgctttttttaaatgtattggaatccttatactgtttaaccttgggatatcgttggaaatcctaaccatcggcataatttttgaagacttgaataactccataatattaagcgtgctggtgcttttgggctcactactgtttagcggactatttatcaatactaagaatattacaaacgtggccttcaagtacctgaaaaacttctctgtgttttactacgcctacgaatctttattgatcaatgaggtcaaaacattgatgctgaaagagagaaagtacggcttaaatattgaagttccaggcgctactatcttgagcacatttggatttgttgtccaaaaccttgtatttgacatcaagatcctggctctgtttaatgtggtgtttttaataatggggtatctagcccttaagtggatagttgtggaacaaaagtag

SEQ ID NO: 6 - protein, 1049 aa, Saccharomyces cerevisiae
MGSHRRYLYYSILSFLLLSCSVVLAKQDKTPFFEGTSSKNSRLTAQDKGNDTCPPCFNCMLPIFECKQFSECNSYTGRCECIEGFAGDDCSLPLCGGLSPDESGNKDRPIRAQNDTCHCDNGWGGINCDVCQEDFVCDAFMPDPSIKGTCYKNGMIVDKVFSGCNVTNEKILQILNGKIPQITFACDKPNQECNFQFWIDQLESFYCGLSDCAFEYDLEQNTSHYKCNDVQCKCVPDTVLCGAKGSIDISDFLTETIKGPGDFSCDLETRQCKFSEPSMNDLILTVFGDPYITLKCESGECVHYSEIPGYKSPSKDPTVSWQGKLVLALTAVMVLALFTFATFYISKSPLFRNGLGSSKSPIRLPDEDAVNNFLQNEDDTLATLSFENITYSVPSINSDGVEETVLNEISGIVKPGQILAIMGGSGAGKTTLLDILAMKRKTGHVSGSIKVNGISMDRKSFSKIIGFVDQDDFLLPTLTVFETVLNSALLRLPKALSFEAKKARVYKVLEELRIIDIKDRIIGNEFDRGISGGEKRRVSIACELVTSPLVLFLDEPTSGLDASNANNVIECLVRLSSDYNRTLVLSIHQPRSNIFYLFDKLVLLSKGEMVYSGNAKKVSEFLRNEGYICPDNYNIADYLIDITFEAGPQGKRRRIRNISDLEAGTDTNDIDNTIHQTTFTSSDGTTQREWAHLAAHRDEIRSLLRDEEDVEGTDGRRGATEIDLNTKLLHDKYKDSVYYAELSQEIEEVLSEGDEESNVLNGDLPTGQQSAGFLQQLSILNSRSFKNMYRNPKLLLGNYLLTILLSLFLGTLYYNVSNDISGFQNRMGLFFFILTYFGFVTFTGLSSFALERIIFIKERSNNYYSPLAYYISKIMSEVVPLRVVPPILLSLIVYPMTGLNMKDNAFFKCIGILILFNLGISLEILTIGIIFEDLNNSIILSVLVLLGSLLFSGLFINTKNITNVAFKYLKNFSVFYYAYESLLINEVKTLMLKERKYGLNIEVPGATILSTFGFVVQNLVFDIKILALFNVVFLIMGYLALKWIVVEQK

SEQ ID NO: 7 - DNA, 4536 bp, Saccharomyces cerevisiae
atgtcttcgactgacgaacatattgagaaagacatttcgtcgagatcgaaccatgacgatgattatgctaattcggtacaatcctacgctgcctccgaaggccaagttgataatgaggatttggcagccacttctcagctatcccgtcacctttcaaacattctttccaatgaagaaggtattgaaaggttggagtctatggcgagagtcatttcacataagacaaagaaggaaatggactcttttgaaattaatgacttagattttgatttgcgctcactattacattatttgaggtctcgtcaattggaacagggaattgaacctggtgattctggtattgcctttaaaaacctaacagcagtcggtgttgatgcctctgctgcatatgggcctagtgttgaagagatgtttagaaatattgctagtataccggcacatctcataagtaaatttaccaagaaatctgatgtcccattaaggaatattattcaaaattgtacgggtgtcgttgaatctggtgaaatgttatttgtcgtcggtaggccaggtgcaggttgctccactttcctaaagtgtctatctggtgaaacttcagaattagttgatgtacaaggtgaattctcctatgatggtctggaccaaagcgaaatgatgtctaagtataaaggttacgttatttactgtcccgagcttgatttccatttcccaaaaattactgtgaaggaaacaatcgattttgccctaaaatgtaagactcctcgtgttagaattgacaaaatgacgagaaagcaatacgttgataacatcagagatatgtggtgtaccgtttttggtttaagacacacatatgccaccaaagtcggtaacgatttcgtaagaggtgtttctggtggtgaacgtaagcgtgtttccttggttgaagctcaggcaatgaatgcctccatctactcttgggataacgccacaagaggtttggatgcctctactgctttagagtttgcccaagccattagaacggctacaaatatggtaaacaactctgctattgttgctatttaccaagctggtgaaaatatttatgaattatttgataaaactactgttctatataacggtagacagatttacttcggtcctgctgataaagctgttggatatttccaaagaatgggttgggttaaaccaaacagaatgacctctgcggaatttttaacatccgtcacggtcgattttgaaaataggacattggatattaaacctggctatgaagataaagttccaaaatctagttcagagtttgaggaatactggttgaactctgaggattatcaggaacttttaagaacttatgatgattatcaaagtagacaccctgttaatgaaacgagagatagactggatgtggccaagaagcaaagactgcaacaaggccaaagagaaaattctcaatatgttgtcaattattggacacaagtttattattgtatgattcgtggttttcaaagggttaagggtgattcaacgtatactaaggtctacttaagttcttttttgatcaaagctttgattatcggttctatgttccacaaaattgatgacaaaagtcaatccaccacggcaggtgcttattctcgtggtggtatgttattctatgttttattgttcgcttctgttacttccttggccgaaattggtaactctttttctagtagacctgttattgtcaaacacaaatcatattccatgtaccatttgtctgcggaatcgttacaagagattatcactgagttccctactaaatttgtcgctattgtgatactatgtttgattacttactggattccatttatgaaatatgaagctggtgctttcttccagtatattttatatctactgactgtgcaacaatgtacttctttcattttcaagtttgttgctactatgagtaaatctggtgtggatgcccatgccgtcggtggtttatgggtcctgatgctttgtgtttatgctggttttgtcttgccaattggtgaaatgcatcattggattagatggcttcatttcattaatcctttaacttatgcttttgaaagtttagtttccactgaatttcaccacagggaaatgttgtgtagcgccttagtcccatctggtcctggttatgaaggtatttctattgctaaccaagtctgtgatgctgctggtgcggttaagggtaacttgtatgttagcggtgactcttacatcttacaccaatatcatttcgcatataagcatgcttggagaaattggggtgtgaacattgtgtggacttttggttatattgtgttcaatgtcatcttatcagaatatttgaaacctgttgagggaggaggtgacttgctgttatataagagaggtcatatgccggagttaggtaccgaaaatgcagatgcaagaaccgcttccagagaggaaatgatggaggctctgaatggtccaaatgtcgatttagaaaaggtcattgcagaaaaggacgttttcacctggaaccatctggactacaccattccatacgacggagctacaagaaaattattatcggatgtctttggttacgttaagcctggtaagatgaccgccttgatgggtgaatccggtgctggtaaaactaccttgttaaatgttttagcacaaagaatcaatatgggtgtcatcactggtgatatgttagtcaatgccaagcccttgcctgcttctttcaacagatcatgtggttatgttgcgcaagccgataatcatatggccgaattatctgttagggaatccctgagatttgcagccgagttaagacagcaaagttccgttccgttagaggagaaatatgaatatgttgaaaaaattatcacattgctaggtatgcaaaattacgctgaagccttagttggtaagactggtagaggtttgaacgttgaacagagaaagaagttatctattggtgttgaactggttgctaaaccatcattattattgtttttggatgagcctacctctggtctggactctcagtctgcttggtcaattgttcaattcatgagagccttagctgattctggtcaatccattttgtgtacgattcatcaaccctctgctaccttgtttgaacagtttgacagattgttgttgttaaagaaaggtggtaagatggtttactttggtgacattggtccaaattctgaaactttgttgaagtattttgaacgtcaatctggtatgaagtgtggtgtttctgaaaatccagctgaatatattttgaattgtattggtgccggtgccactgctagtgttaactctgattggcacgacttatggcttgcttccccagaatgtgccgctgcaagggctgaagttgaagaattacatcgtactttacctggtagagcagttaatgatgatcctgagttagctacaagatttgctgccagttacatgactcaaatcaaatgtgttttacgtagaacagctcttcaattttggagatcgcctgtctatatcagggccaaattctttgaatgtgtcgcatgtgctttgttcgtcggtttatcatatgttggtgtaaatcactctgttggtggtgccattgaggccttttcgtctattttcatgctattattgattgctctggctatgatcaatcaactgcacgtcttcgcttatgatagtagggaattatatgaggttagagaagccgcttctaacactttccattggagtgtcttgttattatgtcatgctgctgttgaaaacttttggtccacactttgtcagtttatgtgtttcatttgctactactggccagctcaattcagtggacgtgcatctcatgcaggtttcttcttcttcttctatgttttaattttcccattatattttgtcacatatggtctatggatcctgtacatgtctcctgatgttccctcagcttctatgattaattccaatttgtttgctgctatgttactgttctgtggtattttacaaccaagagagaaaatgcctgccttctggagaagattgatgtataatgtatcaccatttacctacgtggttcaagctttggttacaccattagttcacaataaaaaggtcgtttgtaatcctcatgaatacaacatcatggacccaccaagcggaaaaacttgtggtgagtttttatctacctatatggacaataataccggttatttggtaaatccaactgccaccgaaaactgtcaatattgcccatacactgttcaagatcaagttgtggctaaatacaatgtcaaatgggatcacagatggagaaactttggtttcatgtgggcttatatttgcttcaatattgccgctatgttgatttgttactatgttgtaagagttaaggtgtggtctttgaagtctgttttgaatttcaagaaatggtttaatgggccaagaaaggaaagacatgaaaaagataccaacattttccaaacagttccaggtgacgaaaataaaatcacgaagaaataa

SEQ ID NO: 8 - protein, 1511 aa, Saccharomyces cerevisiae
MSSTDEHIEKDISSRSNHDDDYANSVQSYAASEGQVDNEDLAATSQLSRHLSNILSNEEGIERLESMARVISHKTKKEMDSFEINDLDFDLRSLLHYLRSRQLEQGIEPGDSGIAFKNLTAVGVDASAAYGPSVEEMFRNIASIPAHLISKFTKKSDVPLRNIIQNCTGVVESGEMLFVVGRPGAGCSTFLKCLSGETSELVDVQGEFSYDGLDQSEMMSKYKGYVIYCPELDFHFPKITVKETIDFALKCKTPRVRIDKMTRKQYVDNIRDMWCTVFGLRHTYATKVGNDFVRGVSGGERKRVSLVEAQAMNASIYSWDNATRGLDASTALEFAQAIRTATNMVNNSAIVAIYQAGENIYELFDKTTVLYNGRQIYFGPADKAVGYFQRMGWVKPNRMTSAEFLTSVTVDFENRTLDIKPGYEDKVPKSSSEFEEYWLNSEDYQELLRTYDDYQSRHPVNETRDRLDVAKKQRLQQGQRENSQYVVNYWTQVYYCMIRGFQRVKGDSTYTKVYLSSFLIKALIIGSMFHKIDDKSQSTTAGAYSRGGMLFYVLLFASVTSLAEIGNSFSSRPVIVKHKSYSMYHLSAESLQEIITEFPTKFVAIVILCLITYWIPFMKYEAGAFFQYILYLLTVQQCTSFIFKFVATMSKSGVDAHAVGGLWVLMLCVYAGFVLPIGEMHHWIRWLHFINPLTYAFESLVSTEFHHREMLCSALVPSGPGYEGISIANQVCDAAGAVKGNLYVSGDSYILHQYHFAYKHAWRNWGVNIVWTFGYIVFNVILSEYLKPVEGGGDLLLYKRGHMPELGTENADARTASREEMMEALNGPNVDLEKVIAEKDVFTWNHLDYTIPYDGATRKLLSDVFGYVKPGKMTALMGESGAGKTTLLNVLAQRINMGVITGDMLVNAKPLPASFNRSCGYVAQADNHMAELSVRESLRFAAELRQQSSVPLEEKYEYVEKIITLLGMQNYAEALVGKTGRGLNVEQRKKLSIGVELVAKPSLLLFLDEPTSGLDSQSAWSIVQFMRALADSGQSILCTIHQPSATLFEQFDRLLLLKKGGKMVYFGDIGPNSETLLKYFERQSGMKCGVSENPAEYILNCIGAGATASVNSDWHDLWLASPECAAARAEVEELHRTLPGRAVNDDPELATRFAASYMTQIKCVLRRTALQFWRSPVYIRAKFFECVACALFVGLSYVGVNHSVGGAIEAFSSIFMLLLIALAMINQLHVFAYDSRELYEVREAASNTFHWSVLLLCHAAVENFWSTLCQFMCFICYYWPAQFSGRASHAGFFFFFYVLIFPLYFVTYGLWILYMSPDVPSASMINSNLFAAMLLFCGILQPREKMPAFWRRLMYNVSPFTYVVQALVTPLVHNKKVVCNPHEYNIMDPPSGKTCGEFLSTYMDNNTGYLVNPTATENCQYCPYTVQDQVVAKYNVKWDHRWRNFGFMWAYICFNIAAMLICYYVVRVKVWSLKSVLNFKKWFNGPRKERHEKDTNIFQTVPGDENKITKK

SEQ ID NO: 9 - DNA, 1761 bp, Saccharomyces cerevisiae
atgtcacgaagtaacagtatatacacagaagatattgagatgtatcctactcacaatgagcagcatctgacgagagaatacacaaaaccagatggtcaaacgaaaagtgaaaaactaaatttcgaaggcgcttatatcaacagtcacgggactctatccaagactaccacaagggaaatagaaggcgatttagactctgagacttcttctcactccagtgatgataaagttgatccaacccaacagataactgcagagacaaaagcgccatatactttactaagttacggtcagaagtggggaatggttgcaattctaacaatgtgtggcttttggtcttcattgggatcaccgatctattatcccgctttgaggcagttggaaaagcaatttaatgtggatgaaaatatggttaacgttactgtggttgtgtatctgttgtttcaaggtatatctcccacagttagcggtggtctggcggattgctttggacggagacctataattttagcaggtatgctgatatacgttattgcatccatcgggctagcatgtgctccatcatacggtgttattatcttcttgaggtgtattcagagtattggtatttcccccacaattgcaatcagttctggtgttgtcggggacttcactttgaagcatgaaagaggtacatttgttggcgccacctcagggtttgttttactgggtcaatgttttggtagtcttattggtgccgtcctgactgcaaggtgggattggagagctatcttttggtttttgaccattggttgtggaagttgttttctaattgcctttcttattttgccagaaacaaagcgaaccattgcaggtaacctttccattaagcctaaaagattcatcaacagagcgccgattttcctactgggcccagttagaaggagattcaagtacgataatcctgattatgagacattagatcccaccattccgaaactagatttgtcatccgccgggaagatccttgtattgccagaaattattctgtctttatttccatcagggctcttatttgctatgtggacgttaatgctttcctctatttcatccggtttatcagtggcgccatacaactatcatttggtcattattggtgtgtgttatctacccggtggtattggcggtttaatgggttccttcttcacaggtagaattattgacatgtatttcaagagaaagatcaagaaattcgagcaagacaaagctaacgggttgattccacaagacgcagagattaatatgttcaaagtccgtttagtttgtcttctgccccaaaatttcttggccgtcgtagcctatcttttatttggttggagtatagataagggctggaggatcgaatctattttaattacttcatttgtctgttcatactgtgctatgagtacattatcaacatcaactacgttattggtcgatttgtacccaacgaaatcatctacagcaagtagttgtttcaactttgttaggtgcagtttgagtaccatcttcatgggttgctttgccaaaatgaaagctgcgatgactgtaggtggtacttttacatttttatgtgcgctggtatttttcttcaacttcttaatgtttattccgatgaaatatggtatgaagtggagggaggatagattattgaaacaacaaagacagtcttggttaaacaccttggcagtcaaagccaaaaagggaacaaaaagagaccagaacgataatcataattaa

SEQ ID NO: 10 - protein, 586 aa, Saccharomyces cerevisiae
MSRSNSIYTEDIEMYPTHNEQHLTREYTKPDGQTKSEKLNFEGAYINSHGTLSKTTTREIEGDLDSETSSHSSDDKVDPTQQITAETKAPYTLLSYGQKWGMVAILTMCGFWSSLGSPIYYPALRQLEKQFNVDENMVNVTVVVYLLFQGISPTVSGGLADCFGRRPIILAGMLIYVIASIGLACAPSYGVIIFLRCIQSIGISPTIAISSGVVGDFTLKHERGTFVGATSGFVLLGQCFGSLIGAVLTARWDWRAIFWFLTIGCGSCFLIAFLILPETKRTIAGNLSIKPKRFINRAPIFLLGPVRRRFKYDNPDYETLDPTIPKLDLSSAGKILVLPEIILSLFPSGLLFAMWTLMLSSISSGLSVAPYNYHLVIIGVCYLPGGIGGLMGSFFTGRIIDMYFKRKIKKFEQDKANGLIPQDAEINMFKVRLVCLLPQNFLAVVAYLLFGWSIDKGWRIESILITSFVCSYCAMSTLSTSTTLLVDLYPTKSSTASSCFNFVRCSLSTIFMGCFAKMKAAMTVGGTFTFLCALVFFFNFLMFIPMKYGMKWREDRLLKQQRQSWLNTLAVKAKKGTKRDQNDNHN

SEQ ID NO: 11 - DNA, 1692 bp, Saccharomyces cerevisiae
atgaccaaacaacaaacttctgtaatgcgtaacgcatctatagccaaggaagaacgtgaaggatctgataataataatgtggacagatccagctcagatgccatcagtgacaacgacgcagaaagatctaattctcattctgaaatagataacgaatcaaattttgatatggtgccttattcaaggttcagccataagcaaaaaatgcttcttgtcgttcagtgtgccttcacaggctttttttcaaccgtggcagggtctatctactatccagtgcttactattattgagaggaaatttaacatcacagaagagttagctaatgtcactattgtggtttattttattttccaaggggtggctccttcaattatgggtggtttagctgatacatttggaaggcggcctattgtattatgggcaatcttagcctacttctgtgcctgcatcggactggcatgtgcacataattacgcccaaatcctggctttaaggtgtttacaggcagcaggtatttctcctgttattgcaataaatagcggaataatgggagatgtaacgacaaaagtagagaggggtggatatgttggattggttgcagggttccaagttgttggaactgcattcggtgcattgattggtgccggattatcctcgaaatggggttggagggcaattttttggtttttggctattggttccggaatttgtctagttttttcaaccttattgatgccagagacaaaaagaactttggtgggaaacggctccgtaacaccaaggtcatttttgaataggtctttgatattgcatgttggttccgtaaaaaaaacattacatttagacgatcctgaccctgagaccttagaaccacgtactagcgtggattttttagcacctttaaaaattttgcacatacgagaaatagacattttattgtccattgccggcctgcaattttccacgtggaccactcatcaaacagccttaacaattgtattgagtaaaaagtacaatctatctgttgcaaaaataggcctgtgctttttacctgcaggaatctcgacactgacaagtattatctctgctggtcggtacttaaattggagctacagaacaagaaaggttaaatacaacagatggattaaagaacaagaattacagctgatggagaaatataaaggtgataaaaacaaggtagcagaacttattcactctaattctcattatgcattcaatttagtggaggcaaggttgcatccagcatttgtgacacttcttctcagtagcattggctttactgcctttggatggtgtatttcggtgaaaacaccgcttgctgctgtattatgcacaagtgcatttgcaagtttattttcaaactgtattttgaccttctctactactttgatagtagatctctttccgtctaaggcttctaccgcaacaggttgcttaaatttatttagatgtctcctatccgcaattttcattgcagcactgaccaagatggtcgagaagatgagatatggaggtgtttttacgtttttgagtgctataacttcatcttcatcgcttttattattctatctcctgaagaatgggaaacaactatcgttcgataggattagggcaaatgataagtcggctggaaggtcagttggtaaaaattcagaaaaagtttcgacgtga

SEQ ID NO: 12 - protein, 563 aa, Saccharomyces cerevisiae
MTKQQTSVMRNASIAKEEREGSDNNNVDRSSSDAISDNDAERSNSHSEIDNESNFDMVPYSRFSHKQKMLLVVQCAFTGFFSTVAGSIYYPVLTIIERKFNITEELANVTIVVYFIFQGVAPSIMGGLADTFGRRPIVLWAILAYFCACIGLACAHNYAQILALRCLQAAGISPVIAINSGIMGDVTTKVERGGYVGLVAGFQVVGTAFGALIGAGLSSKWGWRAIFWFLAIGSGICLVFSTLLMPETKRTLVGNGSVTPRSFLNRSLILHVGSVKKTLHLDDPDPETLEPRTSVDFLAPLKILHIREIDILLSIAGLQFSTWTTHQTALTIVLSKKYNLSVAKIGLCFLPAGISTLTSIISAGRYLNWSYRTRKVKYNRWIKEQELQLMEKYKGDKNKVAELIHSNSHYAFNLVEARLHPAFVTLLLSSIGFTAFGWCISVKTPLAAVLCTSAFASLFSNCILTFSTTLIVDLFPSKASTATGCLNLFRCLLSAIFIAALTKMVEKMRYGGVFTFLSAITSSSSLLLFYLLKNGKQLSFDRIRANDKSAGRSVGKNSEKVST

SEQ ID NO: 13 - DNA, 1629 bp, Saccharomyces cerevisiae
atggcaggagcaacatcaagtataattcgggaaaatgattttgaggacgagcttgcggagagtatgcagtcatataatagagaaactgcagacaaattggctttgactaggaccgagagtgtaaagccagaaccggagataaccgctccgcctcactcacgcttttcccgttctttcaagacagttttaatagctcagtgcgctttcactgggtttttctccacaatagcaggtgccatctactatccagttctgagcgttatagaaagaaaattcgatattgacgaggaattggtgaatgtcactgttgtagtatattttgtatttcagggtcttgcccccacattcatgggcgggtttgccgattcactgggcaggagaccggtggtgcttgtcgcaatcgtcatttattttggtgcctgcatcggtcttgcttgtgctcaaacgtatgctcagatcattgtgctaagatgtctacaagccgccggtatttcacccgtgattgcgattaacagcggaataatgggagatgttactactagagccgagcgcggcgggtacgttggatatgttgctggatttcaagttctaggttctgcgttcggagcccttatcggtgccggattatcatctagatggggatggagagccatcttttggttcttagcaattggatctggcatttgcttcctagcctcgtttttaattttgccagaaacaaagaggaacatatccgggaatggttctgtcaccccaaaatcatacttaaatagagctcccattcttgttttgccaacagtaagaaaatcattgcatttggataatccagattacgaaacattggaactgcccacgcaactaaatctactggcgcccttcaagattttgaaagcttatgaaatttgtatacttatgctagtcgctggattacaatttgccatgtatactacgcaccttacggcgttatccacagctttgagtaaacaatatcacttgactgttgcaaaggtaggattatgctaccttccctccggtatctgcacattatgtagtattgtcattgctggaagatatttgaattggaattacaggcgcagattaaaatattaccaaaattggttgggcaagaagagatcaaagcttttagaagaacacgacaacgaccttaatttggtgcaacgtatcatagaaaatgatcccaaatacacctttaatatcttcaaggcgaggttgcaacccgcatttgttaccttgcttttaagcagtagcggattttgtgcgtacggatggtgcattactgtcaaagcccctttagcggccgttctttgcatgagtggatttgcgtcgctgttttccaattgcattttgactttttcaacaactctaatagttgatctttttcccacgaagacatctacggctacgggatgtttaaaccttttcagatgcattctatctgctgtgtttatagctgcattgagtaaaatggtagaaaaaatgaaattcggaggtgtttttacatttttgggggctttaacctcctcgtcatcgatcctcttatttattctcttgagaaaaggtaaagaattagcctttaagaggaaaaagcaagaactgggagtaaattaa

SEQ ID NO: 14 - protein, 542 aa, Saccharomyces cerevisiae
MAGATSSIIRENDFEDELAESMQSYNRETADKLALTRTESVKPEPEITAPPHSRFSRSFKTVLIAQCAFTGFFSTIAGAIYYPVLSVIERKFDIDEELVNVTVVVYFVFQGLAPTFMGGFADSLGRRPVVLVAIVIYFGACIGLACAQTYAQIIVLRCLQAAGISPVIAINSGIMGDVTTRAERGGYVGYVAGFQVLGSAFGALIGAGLSSRWGWRAIFWFLAIGSGICFLASFLILPETKRNISGNGSVTPKSYLNRAPILVLPTVRKSLHLDNPDYETLELPTQLNLLAPFKILKAYEICILMLVAGLQFAMYTTHLTALSTALSKQYHLTVAKVGLCYLPSGICTLCSIVIAGRYLNWNYRRRLKYYQNWLGKKRSKLLEEHDNDLNLVQRIIENDPKYTFNIFKARLQPAFVTLLLSSSGFCAYGWCITVKAPLAAVLCMSGFASLFSNCILTFSTTLIVDLFPTKTSTATGCLNLFRCILSAVFIAALSKMVEKMKFGGVFTFLGALTSSSSILLFILLRKGKELAFKRKKQELGVN

SEQ ID NO: 15 - DNA, 1827 bp, Saccharomyces cerevisiae
atgaagatgcctctaaagaagatgtttaccagcacgtctcctcgtaactcttcttctcttgacagtgatcatgacgcttactattcgaaacaaaatcctgacaatttccctgtaaaggagcaagaaatctataacattgacctggaagaaaacaatgtgtcctctcgttcatccacctctacatcaccttcagcaagggacgactctttcgcagttccagatggtaaagacgaaaacacgcggttgaggaaagatttaaaggcaagacatatttctatgatcgccattggtggttcattaggtacaggtctgcttataggtacaggtaccgccttattgacgggtggtccggttgcgatgttaattgcatatgcctttgtcggccttttagtcttttacaccatggcctgtcttggtgaaatggcttcttacattccattggatggttttacaagttatgcctcacgttacgtggatcctgcattaggttttgctattggttatacttaccttttcaaatatttcatcttacctcccaaccaacttactgctgctgctttggtcattcaatattggatcagcagagaccgtgttaaccctggtgtgtggattactatattcttggttgttattgtcgctatcaatgtcgtcggtgtaaaattctttggtgaatttgaattttggttgtccagtttcaaagtcatggtaatgttgggtctaatcctgttactatttattattatgcttggtggaggtcctaaccatgaccgcctagggtttagatactggcgtgatcctggtgcgttcaaagaatattcgacggctatcactggtggtaaaggtaaatttgtttcgttcgttgctgttttcgtttacagtcttttcagttacacgggtattgaattgacaggtatcgtttgttctgaagctgagaatccaagaaaaagtgttccaaaggcaattaaattgacagtttaccgtatcattgttttttacctatgcaccgttttccttttgggtatgtgcgttgcatacaatgaccctcgtttactttccacaaaaggtaagagtatgtctgctgcggcatctccattcgtggttgccattcaaaactcaggtattgaagtcttacctcatatcttcaatgcttgtgtcttggttttcgttttcagtgcttgtaactcagatttgtacgtttcttccagaaatttatatgcgttggcaattgatggtaaagcgccaaagatcttcgctaagacaagtagatggggtgttccttacaatgctttaatactctccgtgctgttttgtggcttggcgtacatgaatgtgtcttcaggatcagcaaagattttcaactactttgttaacgttgtttctatgttcggaatcttgagttggatcaccattttaattgtttacatctacttcgataaagcctgccgtgctcaagggattgacaaatcaaaatttgcttatgtcgctcctggccaacgttatggtgcttattttgctttattcttctgcattttgattgctttaatcaaaaacttcactgttttcctaggtcataaatttgattataaaacattcatcaccgggtatattggcctgcctgtctatatcatttcttgggctggttacaaattgatatacaaaaccaaagtgataaagtctaccgacgtggatttgtacacatttaaggaaatatacgatagagaagaagaagagggaagaatgaaggaccaagaaaaggaagagcgtttaaaaagtaacggtaaaaatatggagtggttctatgaaaaatttttgggtaatatcttctag

SEQ ID NO: 16 - protein, 608 aa, Saccharomyces cerevisiae
MKMPLKKMFTSTSPRNSSSLDSDHDAYYSKQNPDNFPVKEQEIYNIDLEENNVSSRSSTSTSPSARDDSFAVPDGKDENTRLRKDLKARHISMIAIGGSLGTGLLIGTGTALLTGGPVAMLIAYAFVGLLVFYTMACLGEMASYIPLDGFTSYASRYVDPALGFAIGYTYLFKYFILPPNQLTAAALVIQYWISRDRVNPGVWITIFLVVIVAINVVGVKFFGEFEFWLSSFKVMVMLGLILLLFIIMLGGGPNHDRLGFRYWRDPGAFKEYSTAITGGKGKFVSFVAVFVYSLFSYTGIELTGIVCSEAENPRKSVPKAIKLTVYRIIVFYLCTVFLLGMCVAYNDPRLLSTKGKSMSAAASPFVVAIQNSGIEVLPHIFNACVLVFVFSACNSDLYVSSRNLYALAIDGKAPKIFAKTSRWGVPYNALILSVLFCGLAYMNVSSGSAKIFNYFVNVVSMFGILSWITILIVYIYFDKACRAQGIDKSKFAYVAPGQRYGAYFALFFCILIALIKNFTVFLGHKFDYKTFITGYIGLPVYIISWAGYKLIYKTKVIKSTDVDLYTFKEIYDREEEEGRMKDQEKEERLKSNGKNMEWFYEKFLGNIF

SEQ ID NO: 17 - DNA, 2835 bp, Saccharomyces cerevisiae
atggacacgcagattgcaataactggcgttgccgtcgggaaagaaatcaataatgataattcaaagaccgaccaaaaagtttctttgccgaaggcggatgtcccatgcatagataaggccacacaaactattatagaaggatgctccaaagatgaccctaggctttcgtatcctacaaaactagagactactgaaaaggggaagaccaaaagaaactcatttgcttgtgtatgctgccattccttgaagcaaaaatgtgagccttctgatgttaacgatatttataggaaaccttgtcgaaggtgtctgaaacacaagaagctgtgcaagtttgatctttcaaaaaggacaaggaagagaaagcctagatcaaggtcacccacaccttttgaatcgccgatggtgaatgtctctactaaaagcaaaggcccaacagattctgaagaatctagcttgaaggatggtacatcttacctcgccagtttcccttctgacccaaacgctaaacaatttccaaactctcggacagtcttacctggacttcaacaaagtttatccgatctttggtcaactttaagccaaccaccctcatatggagcaagagaggccgaaaccacatctaccggagagataaccaccaataatcatacaaaatccaatggcagtgtgcccacaaatccagcagttttagcatctaacgatgagcatactaatattagtgatgcgccagttatatacagtacctacaactcccccgtaccgatttcatctgcgcctaccagcattaacagcgaggcactgttcaaacataggcctaaaattgtgggtgatgaggaaacacagaacgtcaaagtgaaaagacaaaagaaatcatactctagacatatgacacggtcgttcaggaagcagctacaatcactgattatttctcaaaaaggtaaaattagagatatttcgatgaagcttgacacttggtcaaagcagtggaatgaccttgttgaaaagagcatgtttttgccaaccattgcagatcctgtatcagtaggaatcatatctcatgaagaagcgacgcttcgcttacatctttataaaaccgagatttcatatttgtcaaaattaccattcataaaggtcgaagagaatgttagtgtcgatgaattaagaaagaagaaacctattttattctccgtcattatgtcatgtgtttcaattgtactaacacccaaacaaaccaccagaggaactattatgaagcttgatagttttgtactaaacttaattacaaatcagattttcaaggctaataataaatctatcgaaatcatcgaatcactgtctacattatgtctatggtataatttttttgaatggtcaagtaaaacgagataccatatatttaattacatctgttgctgtttaactagagatttggggcctacctatgtcaatcgatcctttggtatgtttagtgacgaggatccaaagagattcaagtcacctttggaactttacagtaatggcgccagtttaactttattggtatacatttccgcactcaatatttcaatttttctacgtcaatcaatacaagctcgttggagtcacgtcacggaaaaggcctgcgaggatttagttaaagagacgaaaaaatcgcgacattatgacaacgataaactattacttgattcagctgatgatcccatcttggttcaatttgctaaaatgaaccacgtcttggaaaatattcacacacacctacatgagagagatctaaatgatgacgagtttgatgatcctatttttactaaaaagtatcttaataaactaatggaaaaataccacaagcaattgcaagagattttcactaaacttgacagaaacaggccaagagtgattgcattttattactctgtagaagcttatttataccagtataaacttgcagtattcatcggggaaatgtcgcataccataaacgaaaaagtcgaattgcccagagaaataatggatgattttgttaaatgctatcattgctgtaaatctgcccttgaggaattttccaagttggagccaattttaattacctcattacctttatttcatacttccaggatcatatataccgttggtatgctcttattaaagctgcgctattccgtagtcgctattccttcgtttcacgatttaatgccccttacagatgatgctattgccttggtaataggggtaaacaatcttttagaaaaaacatcagagctgtatcccttcaacaactctctttacaaatttaggtatgttattgcgttattttgtcaaacctacgcaaacaaagttattgatgttgctgatcgctacaatgcagaaagggagaaactaaaggaaaagcaggtcatagacgaagtaagcaatggccacgatggtacgaagccaataaatgcatatgtaaccgagtcacaaaagatgccaacagaagaagatccaattatcgacaataatacaaaccaaaacataaccgctgtacctgatgaaatgctgccagtatactcaagagttcgtgacgatactgccgcaatgaacctgaatattaacagtacttcatatatgaatgaatccccacatgaacaccgagagagtatgacaggcacaactctattaccaccaccatttatttctaatgatgtgactaactctgctgactcaactaatataaaaccatcacctagttcatcggtagacaacttgaacgattatttgacggatataaactccttagcatggggcgttaattcattaaatgacgagttttggacagaccttttcatgaatgatatttga

SEQ ID NO: 18 - protein, 944 aa, Saccharomyces cerevisiae
MDTQIAITGVAVGKEINNDNSKTDQKVSLPKADVPCIDKATQTIIEGCSKDDPRLSYPTKLETTEKGKTKRNSFACVCCHSLKQKCEPSDVNDIYRKPCRRCLKHKKLCKFDLSKRTRKRKPRSRSPTPFESPMVNVSTKSKGPTDSEESSLKDGTSYLASFPSDPNAKQFPNSRTVLPGLQQSLSDLWSTLSQPPSYGAREAETTSTGEITTNNHTKSNGSVPTNPAVLASNDEHTNISDAPVIYSTYNSPVPISSAPTSINSEALFKHRPKIVGDEETQNVKVKRQKKSYSRHMTRSFRKQLQSLIISQKGKIRDISMKLDTWSKQWNDLVEKSMFLPTIADPVSVGIISHEEATLRLHLYKTEISYLSKLPFIKVEENVSVDELRKKKPILFSVIMSCVSIVLTPKQTTRGTIMKLDSFVLNLITNQIFKANNKSIEIIESLSTLCLWYNFFEWSSKTRYHIFNYICCCLTRDLGPTYVNRSFGMFSDEDPKRFKSPLELYSNGASLTLLVYISALNISIFLRQSIQARWSHVTEKACEDLVKETKKSRHYDNDKLLLDSADDPILVQFAKMNHVLENIHTHLHERDLNDDEFDDPIFTKKYLNKLMEKYHKQLQEIFTKLDRNRPRVIAFYYSVEAYLYQYKLAVFIGEMSHTINEKVELPREIMDDFVKCYHCCKSALEEFSKLEPILITSLPLFHTSRIIYTVGMLLLKLRYSVVAIPSFHDLMPLTDDAIALVIGVNNLLEKTSELYPFNNSLYKFRYVIALFCQTYANKVIDVADRYNAEREKLKEKQVIDEVSNGHDGTKPINAYVTESQKMPTEEDPIIDNNTNQNITAVPDEMLPVYSRVRDDTAAMNLNINSTSYMNESPHEHRESMTGTTLLPPPFISNDVTNSADSTNIKPSPSSSVDNLNDYLTDINSLAWGVNSLNDEFWTDLFMNDI

SEQ ID NO: 19 - DNA, 2382 bp, Kluyveromyces lactis
atgagtgtgatctatagaggcacccactcggaagagtccgatggcagggcatccgactcatcgtcactttctcaaattcaactacagattactgttaaaaatgaaaacacgatctccttggagaaggacatcaaggaagaggaactggttaatgaaagcgaatttcatgatagtgaatctattgatgaggatgatggtcttgtatggaaaggtgatcctacatatttacccaattccccatatccggatgtgagatttgctgtttccattgaggatgatcccacaattcgccttaatcattggagaacatggtttttgacgactatcttcgtggtagtatttgctggggtaaatcaatttttttcgttaaggtatccttcgctcagtatagattttattgtcgcacaagttatttgttatccaattggaaaagtcttggcgaaattaccagactggaaatgtcggagagtgccattttttgatttaaatcctggtccgtttaccaaaaaggaacatgctgttgttactattgcagtggctttgacatcatcaactgcatacgcaatgtatattttgaatgcacaaggaagtttttacaacatgaaacttaacgttggatatcaatttctgttagtatggacatcacagatgatcggctatggtgcagctgggctaacgagaagatgggtcgtcaatcctgcgagtgctatttggcctcaaacattaatctctgtatcactttttgattcacttcactctagaaaaattgaaagagcagttgttaatggatggagtatgccccggtataagttttttgtgattgtattcattgcttcatttgtttggtactgggtacctgggttcttgtttactgggctttcttatttcaacgttattctatggggaccaaagacaagggataattttgtggctaatacaatctttggtgttgaaagtgggctaggagctttccctatatcttttgattatacacaaatttcacaagcgatgtctggttctgtgtttgctactccattttatgtttccgcaaatacttatgcgtcagtcttacttttctttgttattattcttccgtgtctctatttctcaaatacttggtatgcgaaatatatgcctgtcatttctggttccacatacgataacacccaaagtaagtataatgtgacaaagattttgaacgaagattactctatcaacctggaaaaatacaaaaattactcgccgatatttgttccattttcgtatctcttatcttatgcgttaaattttgcagccgttatcgcggtattcgttcactgcatattgtatcatggcaaagacattcttgcaaaattaaaagatcgtaggaatggtgggactgatattcatgccagaatatattccaaaaactacgcagattgccctgattggtggtatcttgttttgcaagtcgttatgatcgggttaggttttgtaacggtctgtgcatttgattctaaatttcctgcctgggcttttgttattgcgatactaatctcacttgtcaattttattccccagggaatcttggaagctatgacaaaccaacatgttggacttaacattattactgaactaatttgcggttatatgcttcctttacggccaatggctaatttgctattcaaattgtatggatttattgtgatgaggcaaggcctgaatttgagtagagacctcaagttagccatgtatatgaaggtcccgccacgccttattttttttattcaaatctatgccactattctttctgggatggtaaatgtcggggttcaggaatggatgacgcataacatcgaggggatatgttctacagatcaatcaaacgggtttacttgtgccaatggccgtactgtatttaatgcatcaatcatctggtctttgccaaaatatctgttctcacccggtcgtatttataatccattgatgtggttttttttgattggtctagtggtcccactgattgtatacgccattcaacggaagttccccaaaattcaatttgctaaatatattcacacccctgtattcttcacaggaccaggaaatatcccaccaagtacgccttacaactactcgttgtttttttcagcgtctttttgtttacatattataagaaagcgctggggaccttggtttaagaaatacaattatgttatgggggcggcagttgagtcaggcgttgcgattgcagttgtcattattttcctatgtgttcagttccctggtgcggaactcaattggtggggaaataatgtttggaagaatacctatgaccataactacaaaaagttttacaccctcgaggaaggtcagacttttggacatactaaatggtggtga

SEQ ID NO: 20 - protein, 793 aa, Kluyveromyces lactis
MSVIYRGTHSEESDGRASDSSSLSQIQLQITVKNENTISLEKDIKEEELVNESEFHDSESIDEDDGLVWKGDPTYLPNSPYPDVRFAVSIEDDPTIRLNHWRTWFLTTIFVVVFAGVNQFFSLRYPSLSIDFIVAQVICYPIGKVLAKLPDWKCRRVPFFDLNPGPFTKKEHAVVTIAVALTSSTAYAMYILNAQGSFYNMKLNVGYQFLLVWTSQMIGYGAAGLTRRWVVNPASAIWPQTLISVSLFDSLHSRKIERAVVNGWSMPRYKFFVIVFIASFVWYWVPGFLFTGLSYFNVILWGPKTRDNFVANTIFGVESGLGAFPISFDYTQISQAMSGSVFATPFYVSANTYASVLLFFVIILPCLYFSNTWYAKYMPVISGSTYDNTQSKYNVTKILNEDYSINLEKYKNYSPIFVPFSYLLSYALNFAAVIAVFVHCILYHGKDILAKLKDRRNGGTDIHARIYSKNYADCPDWWYLVLQVVMIGLGFVTVCAFDSKFPAWAFVIAILISLVNFIPQGILEAMTNQHVGLNIITELICGYMLPLRPMANLLFKLYGFIVMRQGLNLSRDLKLAMYMKVPPRLIFFIQIYATILSGMVNVGVQEWMTHNIEGICSTDQSNGFTCANGRTVFNASIIWSLPKYLFSPGRIYNPLMWFFLIGLVVPLIVYAIQRKFPKIQFAKYIHTPVFFTGPGNIPPSTPYNYSLFFSASFCLHIIRKRWGPWFKKYNYVMGAAVESGVAIAVVIIFLCVQFPGAELNWWGNNVWKNTYDHNYKKFYTLEEGQTFGHTKWW

SEQ ID NO: 21 - DNA, 2391 bp, Ashbya gossypii
atggctgatttgagcggcactgcagtaaagcgggagcctgagaaaggccccgcgtcagcgcttgatacgacaggggatcttcctcatatatatgatacagtgagtgtggagacgcctggaccattcgaaactagtgaaaaaaaggtagataaagagggggcagatacagagggagatagcggtgagttcactgatgtgctggtggaggacgattcgccgtaccctgaggtgcgggccgccgtgccgtcgtttgatgacaccaccatgctccagaacacggtacgaatgtggacgataggtttgctgatgactacgataggttccgccgtcaatatgttgttctcgatgcacgcgccctcgatggcagtgagtacttttgtgacgtccatgttggcctggcccctaggccggttctgggcccgctgggttccgaatgtgcgtatctttgggcggtttggagggccattcttgaatcctgggccatttagcttaaaggagcacgcacttatcacagtcatggggaacatttccttcggcggtggtgccgcgtatgcgacggatattttactttcaatgaacatgttctataagagggactatggctggttgttcgatttgctggctatctggagcacacaatgtattggattctcgttagctgggctctgttacaaaattttgatcactcctcctttgatgatttggccctcaacgctcgttcagtgcaccttcttgtccaatatacatattcacaacaacaaggtagcaaatggctggaaagttagcagactgaagtttttcatgattatattcatcgctggattcatatattattggttaccgggctaccttttccaagcgctttcttcattcgcctgggttacttggatagcacccaagaacgtcgtcgttaaccaaatttttggttcatctactggtctaggtttgctcccaatcacgtttgactggaatcaaattgcagggtatgttggctcgccgctagtaccgcctatctcagcgattttcactatcttatgttctatggtgacaatattctggatcgtcgtgccaatcgttcattatagtaatacgtggtatggtaactacgtcccgatcagcgattcaacttctatggatcggttccaacagcggtacaatgtcactaaggtagttaaccaaaggctatctctagatcttgaagcctatcattcctattcccgattgtatttacctaccacgtttgcaatatcctatggtatgtcgtttgcctctgtcatggcaaccatctctcacactgcctgttttcactggagaaccatatacaatggtgtgcgtaatataaatacgcaggaccgagatgtccacgcaaggctaatggaaagatacaaggctccgccttattggtggtatctagtaaccttttttgttttcttggcgttgtctatcgcaactgtacgggcttgggatactcaattgccggtttgggccctattcttagcgctagccattgcaggtttctttctattgccagtgggtattatctacgcgttgacaaacatggcagtcggcttgaacgttatcacggagttcatcattggttacatgctaccaggcagaccgatagcgatgatgttcttcaaaacttttggatatatcaccaacagccaggccatcacatttgcacaggacatgaagttgggccactacttaaaggtcgctcccaaactcatgtttaccgcgcaattcattgccaccatatggggcagtaccgtgcagatagccgttttgagatggtcagaggcaaacataaagggcctctgtaccaaagcgcagcccggccactttacatgccctggtgccaccgttttcttcactgcatctatcatctggggtgtcatcggtccgcagcgcatgttctctgccggtcaaatgtacagttccttaaactactttttcgtgcttggctttttcctccctatcgtgaactggctcattttgagcaagtggtccaagcgcttcgagaagtcgggtaggggactaaagtttgtcgccaaatatttgtcctggcctgtcttctttagtggcactggactaataccccccgctacaccatacaattacggttcatactgtatagtcgggattttcttcggctacttcattaagcggtactacttccagtggtggtgtaagtacaactacagtttgagtgccgcgcttgacatcggtttagcttggggcgctctaatcatctttttctcgacaggaatagcggttaggaaggcgcctgtgtggtggggtaacaccgtcattgatacgcttgatacaaatggtcaggcgattaaatatatactccaggaaggggaatactttgaccgagcatctccatga

SEQ ID NO: 22 - protein, 796 aa, Ashyba gossypii
MADLSGTAVKREPEKGPASALDTTGDLPHIYDTVSVETPGPFETSEKKVDKEGADTEGDSGEFTDVLVEDDSPYPEVRAAVPSFDDTTMLQNTVRMWTIGLLMTTIGSAVNMLFSMHAPSMAVSTFVTSMLAWPLGRFWARWVPNVRIFGRFGGPFLNPGPFSLKEHALITVMGNISFGGGAAYATDILLSMNMFYKRDYGWLFDLLAIWSTQCIGFSLAGLCYKILITPPLMIWPSTLVQCTFLSNIHIHNNKVANGWKVSRLKFFMIIFIAGFIYYWLPGYLFQALSSFAWVTWIAPKNVVVNQIFGSSTGLGLLPITFDWNQIAGYVGSPLVPPISAIFTILCSMVTIFWIVVPIVHYSNTWYGNYVPISDSTSMDRFQQRYNVTKVVNQRLSLDLEAYHSYSRLYLPTTFAISYGMSFASVMATISHTACFHWRTIYNGVRNINTQDRDVHARLMERYKAPPYWWYLVTFFVFLALSIATVRAWDTQLPVWALFLALAIAGFFLLPVGIIYALTNMAVGLNVITEFIIGYMLPGRPIAMMFFKTFGYITNSQAITFAQDMKLGHYLKVAPKLMFTAQFIATIWGSTVQIAVLRWSEANIKGLCTKAQPGHFTCPGATVFFTASIIWGVIGPQRMFSAGQMYSSLNYFFVLGFFLPIVNWLILSKWSKRFEKSGRGLKFVAKYLSWPVFFSGTGLIPPATPYNYGSYCIVGIFFGYFIKRYYFQWWCKYNYSLSAALDIGLAWGALIIFFSTGIAVRKAPVWWGNTVIDTLDTNGQAIKYILQEGEYFDRASP

SEQ ID NO: 23 - DNA, 2418 bp, Saccharomyces kluyveri
atgaacgttttagagcttgtcatttccaatgatactctatttacagagcaggactcaataaggtccagcaattccgatagaagtttcgacactgatagcgggaaggataggattgtgttcttccctcaagaagcttcagttgccaaagccgaacctattgcatctacggcctttcaaaacgattcgattgaccccaatgagttgggaagaaaagtatcatcagaagttctagatgatgggtacgccggtattacagtcgacgacgattccccgtatgctgaggtccgtgcggcagttccttccactgacaatcctgtaataccccaaaatactattcgtatgtggaccttaggtttcataatgacaacgattggttctgccatcaatatgctgttttctatgcactctccatctatcattcttacaacttttgtcacctctatcttggcctggccactaggaaaagcctgggcaaggtttcttccggacgttcggatctttggaaagtacggtggtccatctttaaaccctggcccattcaatctgaaggagcacacgttaatcacggtcatgggtaacgtgtcctttggtggtggtaatgcgtacgctacggatattcttttgtccatgaacaacttctatggtactgattttggatgggggtttggcttgcttgcaatttggtccactcaatgtatcggtttttccttggctggtttagcgaagaagatactggttactccatccaccatgatttggccatccaacttagttacgtgtacctttttgaccaacttgcacatcaatgaaaaccatagtgccagcggatggactatttctcgtttaaggtttttcttcctggtctttttaattgggtttctatactattggtttcctggattcatctttgagggactgtcttattttgcatgggtcacatggattaaaccaaacaatgttgtcatcaatcaggtttttggtgcatcaactggcttgggattgatcccaataactttcgattggaaccaaattgcaggctacacaggctcaccactgattccaccggtaggtgttttggttaccattctattatctatggttataattttctggattgttgttcctattatccactattccaatgtttggtacggaaaatatttaccgatatccgactcagaatcttatgacagatttcaacagccttacaacgtcagcaaaatcgttgacgacagcctgactttcgaccctgctggatataaaaagtactccccactgtacctgtccgcctcatttgccattgcttatggtatgtcctttgcatctacaactgccacaattgttcatgctgttttatttcacggcaaagatgtctgggatcaggcaaggtctttaaaagttgaagaagaagatgtccacgcaagactaatgagagaatacaaagaaaccccatgttggtggtatgccatagtgtttttggtattttttgggttggcagtagtcaccgtcagagtttggaataccgaaatgccagtttacgcgctaatcatagctctagtaattgctgctttctttctactaccaattggtattatatacgccctaaccaatatccctgttgggctaaatgtgtttactgagttcattgttggttatatgctgccaggcaagccaatagcaatgatgttttttaaaaccttcggttacattacaaacaaccaggctattattttcgctcaggacatgaaactgggtcattacatgaaggtcgcaccgaggctgttgtttacggcacaatttctcgctacaatttggggatctctggtccaaatctgcgttttaaaatgggctcaagatacaattcctggactttgcagcgatgaccaaaaggataattacacatgtccaggttctcgtgtctttttcaacgcttctgtgatctggggtgtgattggtccagataaaatgttttccagcggcaaaatctacaacggccttctatactttttcctcctaggtgcaatacttccagtgatcaactggttgattctgagaaagtggccaaattctctgatccagtacatgaattggccagttttcttttctggtactgccatgattccaccggctactccattcaactatggcgcttattgtatggttgggatattctttggctactacgtcagaagaaaatggttccattggtggtccaagtataactactctctttctgcaggtctagatattggtttagcatggtcctccttgattatcttcctgtgtctatatctaaccaacgctagctttccggattggtggggtaactccgttgtcgattcgactatggatagctggggtactgccatccagaggcaactatccgatggagaatcttttggcttgaccagctggtaa

SEQ ID NO: 24 - protein, 805 aa, Saccharomyces kluyveri
MNVLELVISNDTLFTEQDSIRSSNSDRSFDTDSGKDRIVFFPQEASVAKAEPIASTAFQNDSIDPNELGRKVSSEVLDDGYAGITVDDDSPYAEVRAAVPSTDNPVIPQNTIRMWTLGFIMTTIGSAINMLFSMHSPSIILTTFVTSILAWPLGKAWARFLPDVRIFGKYGGPSLNPGPFNLKEHTLITVMGNVSFGGGNAYATDILLSMNNFYGTDFGWGFGLLAIWSTQCIGFSLAGLAKKILVTPSTMIWPSNLVTCTFLTNLHINENHSASGWTISRLRFFFLVFLIGFLYYWFPGFIFEGLSYFAWVTWIKPNNVVINQVFGASTGLGLIPITFDWNQIAGYTGSPLIPPVGVLVTILLSMVIIFWIVVPIIHYSNVWYGKYLPISDSESYDRFQQPYNVSKIVDDSLTFDPAGYKKYSPLYLSASFAIAYGMSFASTTATIVHAVLFHGKDVWDQARSLKVEEEDVHARLMREYKETPCWWYAIVFLVFFGLAVVTVRVWNTEMPVYALIIALVIAAFFLLPIGIIYALTNIPVGLNVFTEFIVGYMLPGKPIAMMFFKTFGYITNNQAIIFAQDMKLGHYMKVAPRLLFTAQFLATIWGSLVQICVLKWAQDTIPGLCSDDQKDNYTCPGSRVFFNASVIWGVIGPDKMFSSGKIYNGLLYFFLLGAILPVINWLILRKWPNSLIQYMNWPVFFSGTAMIPPATPFNYGAYCMVGIFFGYYVRRKWFHWWSKYNYSLSAGLDIGLAWSSLIIFLCLYLTNASFPDWWGNSVVDSTMDSWGTAIQRQLSDGESFGLTSW

SEQ ID NO: 25 - DNA, 2349 bp, Kluyveromyces waltii
atgagcaaagaagttaagaaggtggaaacgctgcaagtgtgggaaaaggtcgagaactcgagcgaatcgagctcgcaggaacatgttccgcacgtgatcaacaaggacggcgcgggtatcgttgtggaggaggaagagtcggaagccgaaggcataactgaccagaccatatgggagggtgatgtgacagctctgcccaactcaccttttcccgaggtacgtgccacagtgcctgccacggacgaccctacgatagtggtcaaccattggcgcacgtggtttctcacgacagtgttcgtagtagtgtttgccggcgttaatcagttcttctcgctgcgttacccatctttatccatcaatttcctggtagcacaagttgtgtgctatcctatcggtaaaatactggcattgctgccccagcgggattgcgcccggtgcccctggttcaacctaaaccccggacccttcactaagaaagagcatgcagttgttaccattgcagtggctttgacctcgagtactgcgtacgctatgaacattctcatcgcccaaactaatttctacaacatgaaactcggagcgggatatatggtcctcttggtttggacctctcagatgctgggctacggcgctgcgggccttaccagacgttgggtagttgagccagcggcttgtatctggcctcagaccctcatttccgtgtccttgttcgactctctgcacaacagaactgtagatgcttcggttgttaacggctggaagatgtcccgttacagattctttattatcgtgttgtccggtagtttcatctggtactgggtaccaggtttcctattcaagggcttgtcctactttaatgttgtactctggggatccaagaccagacacaatttcattgcaaacactatttttggtgtcgagagtggtatcggagcactgccgatttcttttgactacactcaagtttcccaagctatgagtggttctgtcttcgctacaccatactgggtgagcgcaaactcctgtgcatcggtgttcatctttttcatcctcatccttcccatcttgtattttaccaacacttggtatgccaaatacatgccagtaatctctggtaacactttcgataacactcagcagaagtacaatgtttccaagattttaaacccggatttctccgtcaacctggaaaaatataaagcctattcacctttgtttgtgccattctcctacctattgagttatgctctaaactttgccgctgttgtcgcggtgtttgtgcactgtgctctctataatggaaaagacatcaaaaacaaattcagaaacaagaatcacggtggacaggacatacacatgagactttatacccaaaactataaggactgcccagactggtggtaccttgttttacaagtcgtgatgttaggattgggatttgctacaatttgtggttttgactcacacctcccagcttgggcttttttcgtggcacttgtgatctcgttcttgaacttcattcctcaaggcattctagaagcagtaacaaaccaacacgttggtctcaatattatcaccgaactgatttgcggttatatgctgcctttcaaacctatggcaaatgttctgttcaagctctatggcttcattgtgatgaggcaaggcctagagctgagtagggatttgaaacttgcactgtacatgaaagttccaccacgtttaattttcgccattcagatctatgccaccatcatttccgggctggtcaatgtaggtattcaagaatggatgagatctaacattaaagaattgtgttcttcgactcaacctgacggatttacttgtaataacgggcgcaccattttcaatgcatccatcatctggtccatgcctcaatttctgttttccccgggccgtatctataatcccatcatgtggtttttcctaatcggcttggcggttcccctgatagtgttcgcattacaaagggtatttaaacacaatcaggctattaaattcatgcatgcgccagtcttctttgccggtccaaacagcattcctcctagtacgccctacaactactcattgttctttgcaatgtcctacgtgttgaatagaattagaaagagatggccactctggttcagcaaatacaattacgttatgggtgctggcgttgagactggtgtggcgttggcagttgttattatcttcttgtgcgttcaatacccaggtggaaaattgaactggtggggcaacagtgtctacaagaacacttacgaccatgcctaccgcaaatactacgtcttgaagaagggcgaaactttcggctacgacaaatggtggtga

SEQ ID NO: 26 - protein, 782 aa, Kluyveromyces waltii
MSKEVKKVETLQVWEKVENSSESSSQEHVPHVINKDGAGIVVEEEESEAEGITDQTIWEGDVTALPNSPFPEVRATVPATDDPTIVVNHWRTWFLTTVFVVVFAGVNQFFSLRYPSLSINFLVAQVVCYPIGKILALLPQRDCARCPWFNLNPGPFTKKEHAVVTIAVALTSSTAYAMNILIAQTNFYNMKLGAGYMVLLVWTSQMLGYGAAGLTRRWVVEPAACIWPQTLISVSLFDSLHNRTVDASVVNGWKMSRYRFFIIVLSGSFIWYWVPGFLFKGLSYFNVVLWGSKTRHNFIANTIFGVESGIGALPISFDYTQVSQAMSGSVFATPYWVSANSCASVFIFFILILPILYFTNTWYAKYMPVISGNTFDNTQQKYNVSKILNPDFSVNLEKYKAYSPLFVPFSYLLSYALNFAAVVAVFVHCALYNGKDIKNKFRNKNHGGQDIHMRLYTQNYKDCPDWWYLVLQVVMLGLGFATICGFDSHLPAWAFFVALVISFLNFIPQGILEAVTNQHVGLNIITELICGYMLPFKPMANVLFKLYGFIVMRQGLELSRDLKLALYMKVPPRLIFAIQIYATIISGLVNVGIQEWMRSNIKELCSSTQPDGFTCNNGRTIFNASIIWSMPQFLFSPGRIYNPIMWFFLIGLAVPLIVFALQRVFKHNQAIKFMHAPVFFAGPNSIPPSTPYNYSLFFAMSYVLNRIRKRWPLWFSKYNYVMGAGVETGVALAVVIIFLCVQYPGGKLNWWGNSVYKNTYDHAYRKYYVLKKGETFGYDKWW

SEQ ID NO: 27 - DNA, 2484 bp, Kluyveromyces thermotolerans
atgttatataaggaggcaaccagttcaactgaggcggctatgcatcgaagctctgaagacaagtcaccagctcacaattctaatcacctcaaaatgggaaaggaggtgaaaattgtcgacacacttcaagtggtcgaacatggggaaaactctagcgatagcagctctctggggcaggaacttagccctgggggatcacatgtcacatacctctctagaggtcatctagcgaatgaaggcgcgggcgccgaggggaaaactgagcaggaaattattgaagaggaagagctcactgagcaaactgtttgggaagggaacgtttcacttctacaaaactctccctttccggaggttcgtgccacggtcccaccaacagacgaccctacgattgtgttgaatcactggaggacctggttcttgactacagtctttgtgatagtgttcgcgggtgtcaaccaatttttctcgttacgctatccctcgctttctatcaactttttggtcgctcaggttgtttgttatcctgttggaaaaattctagcactgctccccgagtgggattgccctcgttgcccctggttcaacctcaatccaggtccattcactaaaaaggagcacgcagttgttacaattgctgtcgctctgacctctagtactgcgtacgccatgaatattttgattgcacaaacaaatttttacaacatgaagctttcagcaggttacatgattctacttgtatggacctcccaaatgttggtatacggagcagctgggctaacccgaagatgggtcgtttcgccagcggcttgcatatggccccaaacacttatttcggtctcactttttgattccttgcacaacaggtctattgataagactaaggtgaatggctggagcatgtcccgttacaggttttttgtcacggtgttctcggctagttttgtatggtactgggttccagggtttctgttcaagggtttatcttatttcaatgtggtcctctggggccctaagaccaggcacaattttatcgctaacaccatctttggtgttgaaagtggcattggtgctctacctatcacttttgactatacacaaatctctcaagcgttaactggctctgttttcgccacaccctactgggtcagtgcgaactcatgcgcctcagctgttctgttcttcgttatcattttgccaatcctctacttcaccaatacttggtacgcaaaatacatgccagtcatctcgggaagcacttacgacaatactcagcagaagtacaatgtcagcaggattctcaactcagactattctattaacttcgaaaaatacaaatcgtattctcccctattcgtccctttctcatacttactgagttatgcacttaactttgcagccgtaatcgctgtatttgttcactgcttcctctacaatggaaaagagatcaaaaacaaatttagaaacaagaactatggggggcaggacatccacatgaggctatattcccaaaactacaaggactgtcctgattggtggtacgttgttttacaggttatcatgatagccttgggttttgttgcagtttgcgcgtttaactcgcaccttcctgcttgggcttttgtggttgcacttgcgatttccttcgtgaactttatcccccaaggtattttagaggcagttacaaatcaacacgtcggcttgaacattattactgagttgatttgtggctacatgttgccatttagacctatggctaacctcctctttaagctatacggattcattgtaatgagacaaggtctcgagctgagcagggatctgaagctcgcactttacatgaaagtacctccacgtctaatatttgctgttcagatttacgccactgtcatatcgggactggtcaatgttggaattcaagagtggatgagatcgaatatcaaggaattgtgttcatccactcaaccggatggttttacatgcaacaatggccgcacaatcttcaacgcttccattatctggtccatgcctaagtacttgttttccccgggtcgcatatacaaccccatcatgtggtttttcttgatagggcttgttgtacctatcattgtctttgtgcttcaaaagaagttcaagggaaatgaaatgctgaagttctgccattcacctgtctttttcgcagggccaggcaacattccacccagcaccccttataactacaccctatattttgccttgtcgtgggcgcttaacacaatcagaaaaaggtttcctcggtggttcagcaagtacaactttgttatgggtgctggcgtcgagactggagtggctttagctgtggttataattttcttgtgcgttcaatatcctggtggctcgctgaactggtgggggaacaatgtttacaagaacacttacgatcacaattatcggaagttttacaacttaaagaaaggggagaagtttggttatgacaaatggtggtga

SEQ ID NO: 28 - protein, 827 aa, Kluyveromyces thermotolerans
MLYKEATSSTEAAMHRSSEDKSPAHNSNHLKMGKEVKIVDTLQVVEHGENSSDSSSLGQELSPGGSHVTYLSRGHLANEGAGAEGKTEQEIIEEEELTEQTVWEGNVSLLQNSPFPEVRATVPPTDDPTIVLNHWRTWFLTTVFVIVFAGVNQFFSLRYPSLSINFLVAQVVCYPVGKILALLPEWDCPRCPWFNLNPGPFTKKEHAVVTIAVALTSSTAYAMNILIAQTNFYNMKLSAGYMILLVWTSQMLVYGAAGLTRRWVVSPAACIWPQTLISVSLFDSLHNRSIDKTKVNGWSMSRYRFFVTVFSASFVWYWVPGFLFKGLSYFNVVLWGPKTRHNFIANTIFGVESGIGALPITFDYTQISQALTGSVFATPYWVSANSCASAVLFFVIILPILYFTNTWYAKYMPVISGSTYDNTQQKYNVSRILNSDYSINFEKYKSYSPLFVPFSYLLSYALNFAAVIAVFVHCFLYNGKEIKNKFRNKNYGGQDIHMRLYSQNYKDCPDWWYVVLQVIMIALGFVAVCAFNSHLPAWAFVVALAISFVNFIPQGILEAVTNQHVGLNIITELICGYMLPFRPMANLLFKLYGFIVMRQGLELSRDLKLALYMKVPPRLIFAVQIYATVISGLVNVGIQEWMRSNIKELCSSTQPDGFTCNNGRTIFNASIIWSMPKYLFSPGRIYNPIMWFFLIGLVVPIIVFVLQKKFKGNEMLKFCHSPVFFAGPGNIPPSTPYNYTLYFALSWALNTIRKRFPRWFSKYNFVMGAGVETGVALAVVIIFLCVQYPGGSLNWWGNNVYKNTYDHNYRKFYNLKKGEKFGYDKWW

SEQ ID NO: 29 - DNA, 2445 bp, Kluyveromyces thermotolerans
atgaaaaacgtactcaaatctattctgtcttcggacgccccggtgacagacaagaaactgctccatccggcggacagcagcagcggcgctgccgccagctccgccagcgacgccggcaagggcaaaggtgacacgatcgtggtgacagagcgcgactcgtccgaccacgacatcgaaaagagccgttccgtaggcctcgccgcgttgcggtccgcagactacgacccgctcggaggtaagatctcggcgatcgcggagaacgacgagtacgcgggtatcaccgtcgaggacgactcgccgtaccccgaggtgcgtgcctccgtgccttccacggacgacccgtcgctcgtgcagaataccatcagaatgtggaccatcggcatgatcatgacgacgatcgggtgcgggctgaacatgctgttctccatgcactcacccacgattgtgctgacgacgttcgtgacgtcgatcttggcgtggcctctgggtcgcgcatgggacatggtgatgcctgacaagcccgttttcgggcggttcggcggcccctcgctcaacccgggtcctttcaacgtcaaagagcacgcgctcatcacggccatgggtaatgtcgcgtttggctcgggaaacgcgtacgccacggacatcatcttgtcgatgaacaacttctacaacaaagacttcggatggggctttgacctgctagccgtatggtccacgcagtgcatcgggttcgcgatggcggggctgtcgcgtaaggtgctagtgacgcccgcgtcgatgatctggcccgccaacctggtcacgtgcaccttcctcaccaacatgcacatcaacgagaaccacgtggccaacggctggaagatctcccgcttaaagtttttcatgatcgtcttcattgtgggcttcgtgtactactggttccccggcttcattttccaagcgctgtcctacttcgcgtgggtcacgtggatcaagcccaaggatgtcatcgtcaaccaggtcttcggcgccagcaccggcctcggtctgattccgctcaccttcgactggaaccagatcgccggttacgtcggatcgcctctggtgcctcctctgggcgtcattgctaccattctgctgtccatggtcattatcttctggattgtggtccccgctgtccactactccaacatctggtacggcaagtacttgcccatttcagactccggctcgtacgaccgttttcaaaacacttacaatgtgtcaaagatcgtttcggagagcctgaccttcaataaggacgcttacagggaatattcaccgctctacctgtcggccacctttgcaatttcctacggcctatcatttgcgggtaccatggccactatcacacacgcgatctgtttccacgggaaacagatctggggagcgattcgcaatattacctcctcagaggaagaagatgttcatgctaagctgatgcgcaactacagggatgtgcctcagtggtggtttatcgttgtgttcttgattttttttggtctttccatcgcaactgtgagagcctggcctaccgagatgcctgtttttacattgatcatcgcacttctgattgcctttttcttcttgctcccagtcggcatcatttacgctctaaccaacattgctgtggggttaaatgtcatcaccgaatttatcattggatacatgacccctggtaagccaattgccatgatgttcttcaagacatttggttacattaccaacaatcaggccatcactttcgctcaggacatgaagatcggccattacatgaaggttgcacccagagtgttattcagtgcgcaactagtcgctactgtttggggtggtttggtccagatgtgcgtcatgaagtgggcacagggcaacattgaggacatctgcacgagcaagcaaaaatcccactttacttgccccggctccaaggtgtttttcaatgcctctatcatctggggcgtgattggtcctcaaagaatgttctctgctggccagatgtatgacaagctcatgtacttttttattctgggcgccggtctcccagttgtgaactggctagttttgaaaaaatggcctcgctccctcgtcaggtaccttaactggcccgtgttcttctcaggaacggggttgatccctccagctaccccttacaactatggtgcctactgcatggttggaattttctttggctacttcatcaagaagaattatttcaactggtgggctaagtacaactactcactgtctgccggtctcgacatttctctagcgtggtcctcgttgatcatctttttggcgcttggtctcaccaacaccgatgcgccaagctggtggggaaacaacgttatcaacaccattgactacgacggtaccgcaattcagcaccagcttacggatggcgaaagcttcggccttaaaaagtggtag

SEQ ID NO: 30 - protein, 814 aa, Kluyveromyces thermotolerans
MKNVLKSILSSDAPVTDKKLLHPADSSSGAAASSASDAGKGKGDTIVVTERDSSDHDIEKSRSVGLAALRSADYDPLGGKISAIAENDEYAGITVEDDSPYPEVRASVPSTDDPSLVQNTIRMWTIGMIMTTIGCGLNMLFSMHSPTIVLTTFVTSILAWPLGRAWDMVMPDKPVFGRFGGPSLNPGPFNVKEHALITAMGNVAFGSGNAYATDIILSMNNFYNKDFGWGFDLLAVWSTQCIGFAMAGLSRKVLVTPASMIWPANLVTCTFLTNMHINENHVANGWKISRLKFFMIVFIVGFVYYWFPGFIFQALSYFAWVTWIKPKDVIVNQVFGASTGLGLIPLTFDWNQIAGYVGSPLVPPLGVIATILLSMVIIFWIVVPAVHYSNIWYGKYLPISDSGSYDRFQNTYNVSKIVSESLTFNKDAYREYSPLYLSATFAISYGLSFAGTMATITHAICFHGKQIWGAIRNITSSEEEDVHAKLMRNYRDVPQWWFIVVFLIFFGLSIATVRAWPTEMPVFTLIIALLIAFFFLLPVGIIYALTNIAVGLNVITEFIIGYMTPGKPIAMMFFKTFGYITNNQAITFAQDMKIGHYMKVAPRVLFSAQLVATVWGGLVQMCVMKWAQGNIEDICTSKQKSHFTCPGSKVFFNASIIWGVIGPQRMFSAGQMYDKLMYFFILGAGLPVVNWLVLKKWPRSLVRYLNWPVFFSGTGLIPPATPYNYGAYCMVGIFFGYFIKKNYFNWWAKYNYSLSAGLDISLAWSSLIIFLALGLTNTDAPSWWGNNVINTIDYDGTAIQHQLTDGESFGLKKW

SEQ ID NO: 31 - DNA, 2397 bp, Zygosaccharomyces rouxii
atgagtagcgggcttgattttaaggaaccagcgctcgaagatactcaggttttgggacgatctcacagcagtaatgcagacactacgatgagtgagacacatgagataaagaactatgatgcaaggagcggcaccgaatccgatcttcctaaggagctcactcaggttaaggtagaagaggtaacgcttactgagacgccggaaggcgttgatgatatatgggaaggagatccctctgaaatgccagattcaccttatccagaggtaagagcagttttatcacccacagatgatccaagtatcgtcctgaaccactggagaacatggtttcttgtgactgtgtttgttgttgtcttcgctggtgttaaccagttcttttctcttaggtatccttcccttacgatcgactttcttgtagcacaggtcatttgctatccgttaggaaagacattggcatgtcttcctgattggaagtgtaagctcgttccgtttttcaatctgaatccaggaccctttacgaaaaaggagcatgcagtggttacaattgcggtggcattgacttcatctacggcttatgccatgtatatcctgaatgcgcaggtgagcttctacaatatgtctgtaaacagcggttaccagttgctgttggtgtggtcatcacaaatgctgggatacggtgccgctggactgaccagaagatgggtggtgaatccggcctcgtgcatatggccccagactctaatttctgtgtcgctgttcgactcattacactccagaaccatagaaaaaagttcggttaacggatggaaggtacctcgctataaattctttcttttcgtcttaattggaagtttcgtgtggtattgggtcccgggtttcttgtttaccggtctctcttatttcaacatcgttctttggggccccaaaacgagacacaacttcgtgcttaatactatctttggggtctctagtggaatcggggctctaccaatttcattcgactatacgcaaatatcccaagccatgacaggatcagtctttgctactccattttgggtttctgccaacacttatgcatcagtcctcattttcttcgtctttttattgccaatcctttatttcacgaatacttggtacgcaaagtatatgcctgttatttccacttctacttttgataacacacagaaaaaatacaatgtgaccaggattttgaatccagattttaccgttaatttggaaaaatataagagttattcaccactctttgttccattttcctaccttctttcctatgcgttgaactttgccgcagttatagcggtgttcgtccattgcggtctctatcatggtaaagacatatatgggaaattaaaggacgccaacttcgggggcagcgatattcacagaagactataccaacagaattataaggactgtccggattggtggtatctcgtcctgcaggttattatgctaggtttgggatttgccgcagtatgtgggtttgacacgcactttccagcatgggcctttgttgttgccctactcatagcctttgctaatttcatcccccagggaatcttagaggctattaccaaccagcacgtagggctcaatgtgattactgagttagtctgcggttatatgttgccctttcgccccatggcaaatcttttgttcaaactgtacggtttcatagtgatgcgccaagggctctcactcagcagggatttaaaacttgccctctacatgaaaattccaccacgtctaatcttttgcattcaaatatatgccactatcgtatcaggtttggtcaacgtaggtgttcaggaatggatgaggcacaacatcaaggatttctgttcaccagaccaaagcaatggattcatctgtgcaaacggacggacggtgttcaacgcatcaatcatttggtctatgccaaagtacctcttcagttctggcagaatatacaaccccttgatgtggttttttctaatagggctcgggctgccgctcgctatctttggtctccaattgctgttgcctaaggtcaacttcttaaagtacatccatactcccattttcttcgctggacccggtaacatcccaccaagtactccttacaattattcacttttcttcgcaatgtccttctggttatatatcatccggagaagatggccgctatggtttaagaagtataattttgtgatgggagctggggtagaggcaggtgttgcaatttctgtcttagtcatatttctgtgtgttcaataccctggcgggaccttaaagtggtgggggaacgacgtttggaaaaacacctacgattaccagtcgaaaaagtactataccgtgaaggcaggagataagttcggctatgataagtggtggtaa

SEQ ID NO: 32 - protein, 798 aa, Zygosaccharomyces rouxii
MSSGLDFKEPALEDTQVLGRSHSSNADTTMSETHEIKNYDARSGTESDLPKELTQVKVEEVTLTETPEGVDDIWEGDPSEMPDSPYPEVRAVLSPTDDPSIVLNHWRTWFLVTVFVVVFAGVNQFFSLRYPSLTIDFLVAQVICYPLGKTLACLPDWKCKLVPFFNLNPGPFTKKEHAVVTIAVALTSSTAYAMYILNAQVSFYNMSVNSGYQLLLVWSSQMLGYGAAGLTRRWVVNPASCIWPQTLISVSLFDSLHSRTIEKSSVNGWKVPRYKFFLFVLIGSFVWYWVPGFLFTGLSYFNIVLWGPKTRHNFVLNTIFGVSSGIGALPISFDYTQISQAMTGSVFATPFWVSANTYASVLIFFVFLLPILYFTNTWYAKYMPVISTSTFDNTQKKYNVTRILNPDFTVNLEKYKSYSPLFVPFSYLLSYALNFAAVIAVFVHCGLYHGKDIYGKLKDANFGGSDIHRRLYQQNYKDCPDWWYLVLQVIMLGLGFAAVCGFDTHFPAWAFVVALLIAFANFIPQGILEAITNQHVGLNVITELVCGYMLPFRPMANLLFKLYGFIVMRQGLSLSRDLKLALYMKIPPRLIFCIQIYATIVSGLVNVGVQEWMRHNIKDFCSPDQSNGFICANGRTVFNASIIWSMPKYLFSSGRIYNPLMWFFLIGLGLPLAIFGLQLLLPKVNFLKYIHTPIFFAGPGNIPPSTPYNYSLFFAMSFWLYIIRRRWPLWFKKYNFVMGAGVEAGVAISVLVIFLCVQYPGGTLKWWGNDVWKNTYDYQSKKYYTVKAGDKFGYDKWW

SEQ ID NO: 33 - DNA, 2394 bp, Saccharomyces kluyveri
atgagttataagcaagaaaaaaattttgaaaaatttgaacgaacttctactagctctctagaacaaacagtaccgttagatacgggtaaagtatcctatgtccctaatccagaatttgaacaagagcgtcaaattgtaaagacattaagcgcaactatagacttagaggacccttcagagaagggctctttacttcaagaccaagacgatgccatttgggaaggtgaccccacatacctcccaaactcaccttacccagaagtgcgtgcaactgtccccaatacggatgatcctacaattgaactaaatcattggagaacctggtttttgacaaccgtatttgtgattgtattcgctggcgtcaaccaattcttttcgttgcgctatcctagtttgagcatcaacttcatagttgcacaagtcatctgctatccaatagggaaaatacttgcaacgctaccagattggaaatgcaaacgggtcccattttttgatttgaatccaggaccatttaccaagaaagagcatgccgttgtcactattgcagtggcattgacatcttctaccgcttatgctatgaatatcttgattgcgcaaacgaacttttacaatatgaaactgggtgctggttatcaagtcctattggtatggacttctcaaatgctaggctacggtgctgccgggctatcaagacgctgggtagttaaccctgcaagctgcgtctggcctcagactttgatctctgtttctttgtttgatgctttgcattcaggtaaaatcgataagacaattgtgaacggttggtccatgacccgttacaagtttttcttgtatgttttcctctttagctttgtctggtattggctcccaggtttcctattcacaggactatcttatttcaatttcattctatggggtccaaagacgagacacaatttcatcgctaacgctatattcggtgtcgaaagtgggttgggtgctattccaattacattcgactatacacaaatatctcaagcaatgactggatctgtctttgcaacgccattctgggtctctgcaaacacttatgcctcggtgctactctttttcgttgtgattttgccgattctatactttacaaacacctggtacgcaaagtacatgcccatcatttccacttctacctacgataaccagcaaaactcttataacgtgaccaaaattttaaatccagatttttccatcaatttggaaaaatacaagggctattctccactttacgttccattctcatatttattgtcgtatgctttgaattttgcagcagtcactgcagtcttcgtccattgtgcactataccatggcaaagatattatttccaagttgagaaacagcaatcatggcggttcagacatccatatgaggctgtattccaaaaactacaaagactgtccagactggtggtacggagctttgcaggtagtgacgttggggcttgggtttgctactgtatgtggatgggacacacatttcccggcatgggcatttgtcattgccctactgatttcgtttgccaacattgtcccacagggaatcttggaggcgatgaccaaccagcatgttggtttaaatatcattaccgaattggtttgtggttatatgctaccactgaagcctatggccaatgttttattcaagctatatgggttcattgtgatgagacatggtctagatttaagccgtgatttgaaactggcgctgtatatgaaagtttcaccacgcttgatatttgctgtccaaatttacgcttcattaatttccggcttggtcaatgttgggattcaagaatggatgagacataacatcgatggtatttgttcaaaaacccaaaaagacgggttcatctgctctaatggacgtaccatttttaatgcgtctattatctggtcattgccacaatacttgttttctcctggtaggatttacaatccattgatgtggttctttttaattggtttggtagtaccgttcattgtattcttcttgcaaaagaagttcccttcaaaccagtttttgaaatactgccatagtcctgtcttttttacaggcccaggaaatatcccaccaagtacaccatataactactctttattttttgcgacttcctttttgttaaatgaaataaggaaaaggtggcctcgttggtttggtaagtacaactttgttatggggtccggtgtcgaagccggtgttgctctttctgtgactataattttcttatgcgttcagtatccaggtggtaaagtaaattggtggggaaacagtgtatggaagaacacttatgatcatcaatacaaaaagttttatcatttaaacaagggggagacttttgggtacgacaaatggtggtaa

SEQ ID NO: 34 - protein, 797 aa, Saccharomyces kluyveri
MSYKQEKNFEKFERTSTSSLEQTVPLDTGKVSYVPNPEFEQERQIVKTLSATIDLEDPSEKGSLLQDQDDAIWEGDPTYLPNSPYPEVRATVPNTDDPTIELNHWRTWFLTTVFVIVFAGVNQFFSLRYPSLSINFIVAQVICYPIGKILATLPDWKCKRVPFFDLNPGPFTKKEHAVVTIAVALTSSTAYAMNILIAQTNFYNMKLGAGYQVLLVWTSQMLGYGAAGLSRRWVVNPASCVWPQTLISVSLFDALHSGKIDKTIVNGWSMTRYKFFLYVFLFSFVWYWLPGFLFTGLSYFNFILWGPKTRHNFIANAIFGVESGLGAIPITFDYTQISQAMTGSVFATPFWVSANTYASVLLFFVVILPILYFTNTWYAKYMPIISTSTYDNQQNSYNVTKILNPDFSINLEKYKGYSPLYVPFSYLLSYALNFAAVTAVFVHCALYHGKDIISKLRNSNHGGSDIHMRLYSKNYKDCPDWWYGALQVVTLGLGFATVCGWDTHFPAWAFVIALLISFANIVPQGILEAMTNQHVGLNIITELVCGYMLPLKPMANVLFKLYGFIVMRHGLDLSRDLKLALYMKVSPRLIFAVQIYASLISGLVNVGIQEWMRHNIDGICSKTQKDGFICSNGRTIFNASIIWSLPQYLFSPGRIYNPLMWFFLIGLVVPFIVFFLQKKFPSNQFLKYCHSPVFFTGPGNIPPSTPYNYSLFFATSFLLNEIRKRWPRWFGKYNFVMGSGVEAGVALSVTIIFLCVQYPGGKVNWWGNSVWKNTYDHQYKKFYHLNKGETFGYDKWW

SEQ ID NO: 35 - DNA, 2433 bp, Kluyveromyces waltii
atgaaaaatctgctcaagaaagctttgtcttcggacacaccagtgacggagaagaacctcctgtatagttccaggtcacaagaggcggccgcggcggatgccgcagccaagggcgatgcaattatgattacggaacaagggtcctctgagcacgacctcgagaagactaagtccggccatctcttacctagacagtccgctgattttgacccgctcgctgcacagctttccgaagcggtggtcaatgatgagtacgctggtatcacggttgaggacgactccccttacccagaagtgcgtgctgcagtaccttcttccgatgacacttctttggtacagaacactgtccgtatgtggacgctcggaatgatcatgagtacaatcggttgtgggttgaacatgctgttctcgatgcactcaccttccattgtgttaaccacttttgtcacttctattttggcgtggcctctaggccgtggctgggaccttattatgcctgacaaaccaatgttcggtagatttggcggtccctcttggaatcctggccctttcaatgtcaaggaacacgcacttatcactgcaatgggtaacgtttctttcggtggaggttctgcctatgctactgacattatcctatccatgaacaatttctacaacaaggattttggctggggcttcgacttgctagccacctggtctactcagtgtattggattcgccatggctggtctggtaagaaacgtgttggttaccccagcgtctatgatctggcctgccaatctggtcactactacctttttaacgaacatgcatgttaacgagaatcacgtcgccaacggatggaccatatccagattaaaattctttttgatcattttcttggctggcttcatctactactggttccctggtttcattttccaggcgctatcctatttcgcatgggttacgtggatcaaacccaatgacgtgatcgtcaaccaagtgtttggcgccagttctggcttgggtttgattcctttaacctttgactggaaccaaatcgcaggttacgtgggctctcctttggtcccacctctaggtgtcattgtaaccattctcctgtctatgattttgatcttctgggtcgtggtgcccgccgtccactactctaacgtatggtacggcaaatatctacccatttctgattcaagttcttatgatagataccagggcacttacaatgtcagcaaaattgtcagcgagaacctttcctttgacaaggcagcctatgaagagtactctccactatacttgtcagcaacatttgcaatctcttacggtttgtcttttgctggcatcacatccaccatcatgcacgccatctgcttccacggcaagctaatttgggaccatatgagaaatatcaagcgtgctgaggacgaagatgtccacgcaagactgatgagacaatacagggatgtgcctcaatggtggtacctaatcgtttttgttatcttttttggtatgtctgtcgctaccattagagcttggccaaccgagatgcccgtgttcactctgattatcgctttgttgattgctttcttcttcctgcttccagtgggtattatctatgccctgacaaacatttcggttggtcttaacgtcattaccgagttcatcattggttacatgacccccggtaagcccatcgcaatgatgttcttcaagacctacggttacattacaaacaaccaagccatcacctttgcccaagacatgaagctaggtcactacctaaagcttgctcctagagttctttttgctgcgcaactcatcgccaccatctggggttctttagttcaaatctgcgtgatgaaatgggctcaagggaacatcgaagacgtgtgtaccagaaagcaggcctcccacttcacctgcccaggtgcaagggtctttttcaacgcgtccatcatctggggtgtcatcggccctcaaagaatgttctctgcaggtcagatgtacaacaagctgatgtatttcttcatcttaggtgctggtcttcccgttgtgaactggctcatcttgaaaaaatggcctggctcttacatcaaatatctgaactggcccgtgtttttctctggtactggtctcatcccccctgccaccccttacaactacggtgcctactgtatggtgggcattatcttcggctactacattaagactcgtttcttcaactggtgggccaagtacaattacacactttcagcggggcttgacatttcgctagcctggtcctcgctcattattttcctcgccttgggcctcaccaacaccgatgcgcccaagtggtggggtaacgatgtcatgaacggcaccatggacaccaactacacggccgttcagagaactttgcaagagggcgaattctttggcctcaaatcctggtag

SEQ ID NO: 36 - protein, 810 aa, Kluyveromyces waltii
MKNLLKKALSSDTPVTEKNLLYSSRSQEAAAADAAAKGDAIMITEQGSSEHDLEKTKSGHLLPRQSADFDPLAAQLSEAVVNDEYAGITVEDDSPYPEVRAAVPSSDDTSLVQNTVRMWTLGMIMSTIGCGLNMLFSMHSPSIVLTTFVTSILAWPLGRGWDLIMPDKPMFGRFGGPSWNPGPFNVKEHALITAMGNVSFGGGSAYATDIILSMNNFYNKDFGWGFDLLATWSTQCIGFAMAGLVRNVLVTPASMIWPANLVTTTFLTNMHVNENHVANGWTISRLKFFLIIFLAGFIYYWFPGFIFQALSYFAWVTWIKPNDVIVNQVFGASSGLGLIPLTFDWNQIAGYVGSPLVPPLGVIVTILLSMILIFWVVVPAVHYSNVWYGKYLPISDSSSYDRYQGTYNVSKIVSENLSFDKAAYEEYSPLYLSATFAISYGLSFAGITSTIMHAICFHGKLIWDHMRNIKRAEDEDVHARLMRQYRDVPQWWYLIVFVIFFGMSVATIRAWPTEMPVFTLIIALLIAFFFLLPVGIIYALTNISVGLNVITEFIIGYMTPGKPIAMMFFKTYGYITNNQAITFAQDMKLGHYLKLAPRVLFAAQLIATIWGSLVQICVMKWAQGNIEDVCTRKQASHFTCPGARVFFNASIIWGVIGPQRMFSAGQMYNKLMYFFILGAGLPVVNWLILKKWPGSYIKYLNWPVFFSGTGLIPPATPYNYGAYCMVGIIFGYYIKTRFFNWWAKYNYTLSAGLDISLAWSSLIIFLALGLTNTDAPKWWGNDVMNGTMDTNYTAVQRTLQEGEFFGLKSW

SEQ ID NO: 37 - DNA, 2418 bp, Saccharomyces kluyveri
atgaatgttataaaatcaattttatctaaagatgctcctgtcacggaaaaggagctgtcacactctgtagattacgaggaacgcttcatctctgatccgaaaaatgacaaaataccttcttcttcttctcaagacgtgtctgccgtcgagttgggcccacacaagtctgccttttctgccactaggtctgcggagtatgatcctttatcggaaaaactatctgctgccgccttggaagacgaatatgccggtatcactatcgaagatgactctccctacccagaagtccgtgctgctgttccatctaccgatgatcctcttctaccacaaaataccgtccgtatgtggaccttgggtctgatcatgaccaccatcggttgtgctttgaatatgctgttctctttgcattctccatccatcgtcttgacgacgtttgtcacttctatcttggcttggcctctcggtaaagcgtgggaaaggtttatcccagatgtcagagtatttggtaagtatggtgggccatctttgaaccctggtccattcaacttaaaggaacacgcgttgatcactattatgggtaacgtttcgtttggtggtggtaacgcttacgcaaccgatattttgttggctatgaataacttttatcataaaaactttggctggggtttcaacttattggctatttggtcgacccaatgtattggttttgcaatggctggtttggctaaggacgttttggtcactccggcttccatggtttggccatccaacctggtcacttgtactttcttgaccaaccttcacgtgaacgaaaatcacaaagcaaatggctggaccatttctcgtttgaagtttttcttcttgatctttgttattggttttgtttactactggttcccgggtttcattttccaagccctgtcgtattttgcctgggtcacttggatcaaaccaaacaacgttatcgttaaccaagtctttggtgcttcgaccggtttgggtataattccgcttactttcgactggaaccaaatcgcaggttatgttggctctcctctaattccacctgccggtgttattttcaccatcttactctctatggtttcgatattttgggttgttgttccagctatccactactccaacgtttggtacggtaaatacctgccaatttccgattctggttcttacgacaggttccaaggcagttacaatgtttcaaggattgtcggcgataatctgacctttgacaaagccgcctacaataaatactcaccattgtacctatctgctacctttgccatatcttatggtatgtccttcgccagtactaccgctaccgtggtccacgctgcactgtttcacggtaaagatatttggaatcaagttagaagggtgaaaactgaggaaaaggatgtccacgctagattaatgcaacaatacaaagacaccccacagtggtggtatgctatagtctttgtagtcttctttggtttgtctattgccaccatcagaggctggaacactgaaatgcccgtgtttgccttggtcattgctttactaattgctgctttcttcttgctaccaattggtatcatttatgccttaacaaatatctctgtcggtctaaatgtcattaccgaatttattatcggttacatgcttccaggtaagccaattgcaatgatgttcttcaaaacttttggctacatcaccaataaccaggccatcacatttgctcaagatatgaagctaggccattacatgaaagttgctccaagaatcatgttttctgcacaattcgtcgctacaatttggggttctttggtccaaatctgtgttttgaagtgggcccaaggtaacatcaaagacatttgtgaacctcatcagaaatctcactttacatgccctggttcccgtgtcttctttaacgcatcagttatttggggtgtcattggcccacagagaatgttttcctctggtcaaatgtacaacaaagtcatgtacttttttctattaggtgcgctattaccaatagttaactggttaattttaaagaaatggccaaactctttagtcagacacttgaactggcctgtgtttttctctggtaccggtctgatcccaccagccactccatataactatggtgcttactgtatggtcgggatcttttttggttattacgtcaaacaaaagtggttccactggtggtccaagtacaactactccttatctgctggcttggatatttccctagcttggtcctcattaatgattttcctatgtttgtcgttaaccaataccgatgctccatcatggtggggtaataacgtcattaacacttcggattatgaaggtactgctatccaagtacagttggaagaagaccaatcctttggtttgaccaagtggtga

SEQ ID NO: 38 - protein, 805 aa, Saccharomyces kluyveri
MNVIKSILSKDAPVTEKELSHSVDYEERFISDPKNDKIPSSSSQDVSAVELGPHKSAFSATRSAEYDPLSEKLSAAALEDEYAGITIEDDSPYPEVRAAVPSTDDPLLPQNTVRMWTLGLIMTTIGCALNMLFSLHSPSIVLTTFVTSILAWPLGKAWERFIPDVRVFGKYGGPSLNPGPFNLKEHALITIMGNVSFGGGNAYATDILLAMNNFYHKNFGWGFNLLAIWSTQCIGFAMAGLAKDVLVTPASMVWPSNLVTCTFLTNLHVNENHKANGWTISRLKFFFLIFVIGFVYYWFPGFIFQALSYFAWVTWIKPNNVIVNQVFGASTGLGIIPLTFDWNQIAGYVGSPLIPPAGVIFTILLSMVSIFWVVVPAIHYSNVWYGKYLPISDSGSYDRFQGSYNVSRIVGDNLTFDKAAYNKYSPLYLSATFAISYGMSFASTTATVVHAALFHGKDIWNQVRRVKTEEKDVHARLMQQYKDTPQWWYAIVFVVFFGLSIATIRGWNTEMPVFALVIALLIAAFFLLPIGIIYALTNISVGLNVITEFIIGYMLPGKPIAMMFFKTFGYITNNQAITFAQDMKLGHYMKVAPRIMFSAQFVATIWGSLVQICVLKWAQGNIKDICEPHQKSHFTCPGSRVFFNASVIWGVIGPQRMFSSGQMYNKVMYFFLLGALLPIVNWLILKKWPNSLVRHLNWPVFFSGTGLIPPATPYNYGAYCMVGIFFGYYVKQKWFHWWSKYNYSLSAGLDISLAWSSLMIFLCLSLTNTDAPSWWGNNVINTSDYEGTAIQVQLEEDQSFGLTKW

SEQ ID NO: 39 - DNA, 2385 bp, Kluyveromyces lactis
atgaatcatattaaatccgttctgtctgctgacgctccggttactgagaaagttctgctagatgttggacaagaacgtagcttcattaattcatctgatgataacttgaacctagaagacaaaaaaagaggccttgaagttaacgttttcgccgcaaggtctgattatcttttgggcagtcagttgtcccatgaagttattgaggatgagtatgcaggtattgtagttgaagatgattctgcttatccagaagttagggccgctgttccttcctctgatgatcccacattaccacaaaacactgtcaggatgtgggttattgggatgctaatggcaactgttgggtctggattgaatttactattttcattacattccccttcgattgttttgagtgcttttgtgaccagcattcttgcctggccgataggtaaggcatgggataaagtgatgccagacgtcaaactttttggccgctttgggggccctagtttaaacccaagtcccttcaatttgaaagagcattgcctgattcaaattatggcaaatgtttccttcggtggtggtgaagcgtatgcaactgacatttttctagccatgaataattattttgaagctgacttcggttggggtttcgatattgttactattcttgctacgcagtgtatcggttttgctttagctggtcttgttaaagacattttgataactccagcttctatgatttggccatctaacttagtcacatgtacattcttgacgaatctccacatcaatgaaaaccatatggcaaatggctggaaaatctctagattaaagttctttttcatggtatttatcattgggtttgtttactattggttcccaggttttatctttcaggcactttcctactttgcttgggtaacttggattaggccagataacgtaatcatcaatcaaattttcggggcttctaccggtcttggtattattcccctcacattcgactggaaccaaatagctggttatgtgggttcacctttagtccctccagtaagtactattttctccatcttactttctatgatcatgattttctgggttacagttccggcaattcattattctaacgtctggttcggtaaatatcttccgatctctgattcggggtcttatgacagatttcaacaatcctacaacgtttcgaaaattgttactcctaatttgtcattcgatattgacgcatacaaaagctactcaccattgtatcttccagcaacatttgttatttcctatggtatgtcttttgcaagcaatactgcaacattagtccatgcagggctatttcacgggaaagagattacgggcgcgtttagaaatgtcaaaaaagaacaggaagatattcataacaggcttatgaaaaactacagggatgtacctcactggtggtacggtatcgttttcctggtcttttttggacttgcaatcgctggcatcagagcatggaataccgaaatgcccgtatgggccttgatattcgcgctagttattgcaggcgtatttttagtgccaattggaattatttgcgctgtcacaagtatctcagttggtttgaacgtcttgactgaatttattatcggttatatcttgccaggtaagcctattgcaatgatgtttttcaagacatttggctacattactaatcatcaagcagtgacctatgcacaagatatgaaactgggtcattacatgaaaattgcccctcgtttaatgttcagcgcgcaatttattgccactgtgtggagttctgttgttcaagtttgtgttttgaaatgggcccagggaaatattacggatgtatgtgatgctcatcaaaagtcacatttcacctgtccaaacgctcgcgttttcttcaatgccgcaattatttggggagttattgggccacagaggatgttcagctctggccagttgtacagtaaagttttatggttcttcttaatcggtgcctcattgccacttatcaactggctggttcttaaaaaatggccaaaatcaccaatcaagtatttaaactggcctgtgttcttctccggtaccggtttaattccaccagcaacaccatataattatggttcttactgtatggtcggtatcacgttcggttattttattaagagaaagtggttccattggtggacgaagtataattattctttgtcagctgctttagatatcagcttggcctggagttctttgatgatttttttctgtttgactttaacaaacactaatgcgcccaactggtgggggaataccgtcattgatactattgactacgagggcacagcaattcagagcattttgaatgatggtgaaagtttcggcttgacaaaatggtag

SEQ ID NO: 40 - protein, 794 aa, Kluyveromyces lactis
MNHIKSVLSADAPVTEKVLLDVGQERSFINSSDDNLNLEDKKRGLEVNVFAARSDYLLGSQLSHEVIEDEYAGIVVEDDSAYPEVRAAVPSSDDPTLPQNTVRMWVIGMLMATVGSGLNLLFSLHSPSIVLSAFVTSILAWPIGKAWDKVMPDVKLFGRFGGPSLNPSPFNLKEHCLIQIMANVSFGGGEAYATDIFLAMNNYFEADFGWGFDIVTILATQCIGFALAGLVKDILITPASMIWPSNLVTCTFLTNLHINENHMANGWKISRLKFFFMVFIIGFVYYWFPGFIFQALSYFAWVTWIRPDNVIINQIFGASTGLGIIPLTFDWNQIAGYVGSPLVPPVSTIFSILLSMIMIFWVTVPAIHYSNVWFGKYLPISDSGSYDRFQQSYNVSKIVTPNLSFDIDAYKSYSPLYLPATFVISYGMSFASNTATLVHAGLFHGKEITGAFRNVKKEQEDIHNRLMKNYRDVPHWWYGIVFLVFFGLAIAGIRAWNTEMPVWALIFALVIAGVFLVPIGIICAVTSISVGLNVLTEFIIGYILPGKPIAMMFFKTFGYITNHQAVTYAQDMKLGHYMKIAPRLMFSAQFIATVWSSVVQVCVLKWAQGNITDVCDAHQKSHFTCPNARVFFNAAIIWGVIGPQRMFSSGQLYSKVLWFFLIGASLPLINWLVLKKWPKSPIKYLNWPVFFSGTGLIPPATPYNYGSYCMVGITFGYFIKRKWFHWWTKYNYSLSAALDISLAWSSLMIFFCLTLTNTNAPNWWGNTVIDTIDYEGTAIQSILNDGESFGLTKW

SEQ ID NO: 41 - DNA, 2406 bp, Saccharomyces bayanus
atgaccattattcacagggacgtcgactcagtagagtcgcagccctcaacatcgctgtcgccagccgtcgtggccatccaggtaagccaggcggaagataagaaggacgagttcgtcaagaacatcgacgaggacgtcaacaacctcactgccaccaccgacgacgaggaccacgaccccgaaagccagaaatacgaccgccactcaatccaggaggagggcctcgtttggaagggcgaccccacatacctgcccaactctccatacccggaggtcagatcagcggtgtccatcgaggacgacccgaccatccgtctcaaccactggagaacttggttcttgaccacgatcttcgtggtggtcttcgcaggtgtcaaccagttcttctctctgaggtatccatcgctcgagattaatttccttgtcgcacaggtcgtgtgttttcccatagggagaatgctggctctcctgcccgactggaagtgtgccagagtgcccttcttcgatttgaatccgggtcccttcaccaagaaggagcacgccgtggtaaccattgccgtggcgctcacctcctccaccgcatatgcaatgtacatcctgaacgcgcagggaagtttctacaacatgaaactgaacgtcggataccagttcttgttggtttggacctctcagatgatcggctacggtgccgccggtctgaccagaagatgggtcgtcaaccctgccagctccatctggcctcaaacgctgatttccgtgtcgttgttcgactcgttgcactctagagatgtcgaaaagtctgtcgccaacggctggaagatgccccgttacaggttcttcctgttcattcttatcgggtcctttatctggtactgggtgcccgggttcctgttcactggactgtcctatttcaacgtcgtcctttggggccccaagacaaggtacaatttcatcgctaacacaatatttggtactcaaagtgggcttggtgccttaccgatcaccttcgactatacccaaatctctcaagccatgtctggctccgtgttcgctacacccttttatgtctccgccaacacttatgcatctgtgttaatttttttcgtcattgtcctaccatgtctatattttaccaacacttggtacgccaaattcatgcccgtcatttcaagttccacttatgacaacactcaaaacaaatacaacgtcacaaagatcctcaacgaggattactccatcaaccttgagaagtataaagaatactcccctgttttcgtcccattttcgtatcttttgtcatacgctttgaattttgccgctgtcattgctgtttttgttcactgtatcctataccatggtaaagatattgttgccaaatttaaagatcgtaaaaatggtggtgttgacattcacatgagaatatactccaaaaactataaagactgccccgactggtggtacttgaccttgcaaatcgtcatgatcggtttagggtttgttgcagtttgttgtttcgacactaagttccctgcttgggcctttgttatcgccatattgatctcccttgtcaatttcattccacaaggtatcctggaagcaatgactaaccagcacgtcggtttgaacattatcactgaactgatatgtggttacatgctgcctttgagaccaatggcgaacttgctattcaaactatatgggtttattgtcatgagacaaggcctaaatttaagcagagatttgaagttggccatgtacatgaaagtctcgccacgtttgatctttgccatccaaatttatgctactatcatatccggtttggttaacgtgggtgtccaagaatggatgatgcataatattgacggcttatgtaccacggatcagccaaatgggttcacttgtgccaatggtcgtacagttttcaattcctccatcatttggtccctacctaaataccttttctcaccggggcgtatttataatccattgatgtggttcttcttgattggtctactattccccatcgtcgtttacgctattcaatggaaattccctaattttaagtttgccaagcacattcatactcctgtctttttcacaggtccaggtaacatcccaccaagtacaccctacaactactcattatttttcgcaacgtctttctgtctacacattataaggaaaagatggagagcttggtacaacaagtacaatttcgtcatgggagccggtgtcgaggcaggtgttgcaatcgctgttgtcattatcttcttatgtgtacaatatccaggtggtaaactcagctggtgggggaacaacgtttggaaaagaacgtatgataatgattataagaaattctacaccttaaagaagggggagacgttcggttatgataaatggtggtaa

SEQ ID NO: 42 - protein, 801 aa, Saccharomyces bayanus
MTIIHRDVDSVESQPSTSLSPAVVAIQVSQAEDKKDEFVKNIDEDVNNLTATTDDEDHDPESQKYDRHSIQEEGLVWKGDPTYLPNSPYPEVRSAVSIEDDPTIRLNHWRTWFLTTIFVVVFAGVNQFFSLRYPSLEINFLVAQVVCFPIGRMLALLPDWKCARVPFFDLNPGPFTKKEHAVVTIAVALTSSTAYAMYILNAQGSFYNMKLNVGYQFLLVWTSQMIGYGAAGLTRRWVVNPASSIWPQTLISVSLFDSLHSRDVEKSVANGWKMPRYRFFLFILIGSFIWYWVPGFLFTGLSYFNVVLWGPKTRYNFIANTIFGTQSGLGALPITFDYTQISQAMSGSVFATPFYVSANTYASVLIFFVIVLPCLYFTNTWYAKFMPVISSSTYDNTQNKYNVTKILNEDYSINLEKYKEYSPVFVPFSYLLSYALNFAAVIAVFVHCILYHGKDIVAKFKDRKNGGVDIHMRIYSKNYKDCPDWWYLTLQIVMIGLGFVAVCCFDTKFPAWAFVIAILISLVNFIPQGILEAMTNQHVGLNIITELICGYMLPLRPMANLLFKLYGFIVMRQGLNLSRDLKLAMYMKVSPRLIFAIQIYATIISGLVNVGVQEWMMHNIDGLCTTDQPNGFTCANGRTVFNSSIIWSLPKYLFSPGRIYNPLMWFFLIGLLFPIVVYAIQWKFPNFKFAKHIHTPVFFTGPGNIPPSTPYNYSLFFATSFCLHIIRKRWRAWYNKYNFVMGAGVEAGVAIAVVIIFLCVQYPGGKLSWWGNNVWKRTYDNDYKKFYTLKKGETFGYDKWW

SEQ ID NO: 43 - DNA, 2382 bp, Kluyveromyces lactis; identical to SEQ ID NO: 19

SEQ ID NO: 44 - protein, 793 aa, Kluyveromyces lactis; identical to SEQ ID NO: 20

SEQ ID NO: 45 - DNA, 2349 bp, Kluyveromyces waltii; identical to SEQ ID NO: 25

SEQ ID NO: 46 - protein, 782 aa, Kluyveromyces waltii; identical to SEQ ID NO: 26

SEQ ID NO: 47 - DNA, 2391 bp, Ashbya gossypii; identical to SEQ ID NO: 21

SEQ ID NO: 48 - protein, 796 aa, Ashbya gossypii; identical to SEQ ID NO: 22

SEQ ID NO: 49 - DNA, 2418 bp, Saccharomyces kluyveri; identical to SEQ ID NO: 23

SEQ ID NO: 50 - protein, 805 aa, Saccharomyces kluyveri; identical to SEQ ID NO: 24

SEQ ID NO: 51 - DNA, 2484 bp, Kluyveromyces thermotolerans; identical to SEQ ID NO: 27

SEQ ID NO: 52 - protein, 827 aa, Kluyveromyces thermotolerans; identical to SEQ ID NO: 28

SEQ ID NO: 53 - DNA, 2679 bp, Kluyveromyces polyspora
atggctgaaaaaaatgacaacaagacccaagtctatgaaatggacgacaggggttccaatggcctagagagaaccaacatatccctcgaagatgattccaatgattccgcagaaaagaaacagcatactaaaattcatactgtcactgaacattcgttcgataccgccgaaggctcttacgatgaagctcaattagaatatgtaatgaaaaaaatgggctaccacaaatatgaggacttatctgacatacctccaactgtagcttatattgcttcaaaggtttcggaattgcctttagaagatgctattgaagaattgagaaaagccgcagaatatcataaagatgatccaaatattcctagtgatgaatatgaagaaataaaatatttgtcaaaccctgaaaatatcgatatagatgataaaaagcaatgctatgaagcaagaattttggcatcgatgattaaattccattctccatacaaagaagtaagggcagtggtagaccctaccgatgatccaactattccagtagaaacatttagatcatatctttttgctttgttttgggctattgtcggttctggttttaatgagttcttctctcacagacaagttacaatcagtattaacacttctgttgttcaaatgttcttgtatccatcaggtttgctatgggccaaatatgttccttgctggggcatcagtattaaaggtagaaaatatgcaatcaatattgataaaccatggtctcaaaaggaacagatgttttcaaccttattattttcaatttgttctggtactttttacacccattataatatcctaactcaaaaagtttactatcatgataatgtttcctttggataccagtttttgttatctttgagcattcaattcttgggttttggttttgctggtattctgagaaagtttgtcgtttatccgacaaaggcgttgtggccaacatcattcccaacaattgcattaaacaaagctttactatctagaaaggaagaaaataccaatgggatgactagatataagtttttcttcctgacattttttgctatgtttatttacaattggttcccaacttatattatcaatatatttaatactttcaattggatgacttggatttcaccaaataatttcaacttggctatgattacaggaggtgtcagtggtatcggttttaacccaattgcgtcgtttgattggaatgtcgcatcttatattaatccattgagaatcccatttttttctaacatgactcaatattgcggtgctgtttttgctgctctagtggtaattgcagtttactggaccaattatatggattgtcaatatttaccattgttttctaatacattgtataccaacagagctactagataccaagttactgaagtgttggatagcgattggaagttagataatgctaaatatcaggaatattcggctccttactatagtgcaggtaacttggtagcctatgggtcatttattgcaacgtatccaatgttaattgtttactcgatgctgacagaaacaaagctgctttggagtgcaatgaagcaatggactttgagtttatggtcactaacaaagaaacatacttggacaaatcttttaactcaagaatcttgtgccttagatgaattcgatgatccacattctcgtatgatgaaaaattataaagaagtgccagattggtggtactttgttgttttgttagctgctattggtgtaggtattgctgttattgaagcgtatcatactaatacaccagtctggtcattatttgtttcaattggtttcaatgttgcatttttaattccattaacaatgttacaagcaacagcaggtttcagtttgggcttgaacttattgattgaaatgattgttggctacgctttacctggtaatccttttgccttaatgattatcaaagcttttggctataatatcgatggccaagctgataattatgtttcaaacttgaaaatggctcattatactaaaattccaccaattgcattattcaggggtcaaatgataatggtttttcttcaaatttttgtcaatttaggagtattaaactggcaaatatctaatatcaagggtttttgtactcatgatcagaaggctaaatttacatgtccggatgctacaacttattataatgcatctgtggtttggggtgctctaggaccaaaaaaaatcttcaatgatgtttatccaattctaagatggtgttggttaatcggtgcttgtattggcctattttttggtgtgtggaagcgttttggtaagttctatccaacatggttcaatccaattctgtttgtgggtggtatgataaacatggcgccaccatacggcttaatgtatttcactccaggaataattgttagctacctatcacaatatcatttcaaaaagtaccatttacgtctatgggaaaaatacaattatattttagatgcaggttttacctctggtttggtcttgtcagctattattatctttttcgctgttcaatatgagggtacaaattttagttggtggggaaataacgttccatatgctgggttagatggtgcaggtccgccattaaaaaacatctcagatacagcaagaggatattttggtcctgaattaggccatctaccataa

SEQ ID NO: 54 - protein, 892 aa, Kluyveromyces polyspora
MAEKNDNKTQVYEMDDRGSNGLERTNISLEDDSNDSAEKKQHTKIHTVTEHSFDTAEGSYDEAQLEYVMKKMGYHKYEDLSDIPPTVAYIASKVSELPLEDAIEELRKAAEYHKDDPNIPSDEYEEIKYLSNPENIDIDDKKQCYEARILASMIKFHSPYKEVRAVVDPTDDPTIPVETFRSYLFALFWAIVGSGFNEFFSHRQVTISINTSVVQMFLYPSGLLWAKYVPCWGISIKGRKYAINIDKPWSQKEQMFSTLLFSICSGTFYTHYNILTQKVYYHDNVSFGYQFLLSLSIQFLGFGFAGILRKFVVYPTKALWPTSFPTIALNKALLSRKEENTNGMTRYKFFFLTFFAMFIYNWFPTYIINIFNTFNWMTWISPNNFNLAMITGGVSGIGFNPIASFDWNVASYINPLRIPFFSNMTQYCGAVFAALVVIAVYWTNYMDCQYLPLFSNTLYTNRATRYQVTEVLDSDWKLDNAKYQEYSAPYYSAGNLVAYGSFIATYPMLIVYSMLTETKLLWSAMKQWTLSLWSLTKKHTWTNLLTQESCALDEFDDPHSRMMKNYKEVPDWWYFVVLLAAIGVGIAVIEAYHTNTPVWSLFVSIGFNVAFLIPLTMLQATAGFSLGLNLLIEMIVGYALPGNPFALMIIKAFGYNIDGQADNYVSNLKMAHYTKIPPIALFRGQMIMVFLQIFVNLGVLNWQISNIKGFCTHDQKAKFTCPDATTYYNASVVWGALGPKKIFNDVYPILRWCWLIGACIGLFFGVWKRFGKFYPTWFNPILFVGGMINMAPPYGLMYFTPGIIVSYLSQYHFKKYHLRLWEKYNYILDAGFTSGLVLSAIIIFFAVQYEGTNFSWWGNNVPYAGLDGAGPPLKNISDTARGYFGPELGHLP

SEQ ID NO: 55 - DNA, 2673 bp, Ashbya gossypii
atgagcaagatctctgaaggtgtcggggaccccccttcgtatggtagccgctcaccaagcttatctagtcacgacaaggaaaaggaaaaatacaatgctggtgcagaagagcaagttaccgcggaggttctcacagacgagcaattggtgtacctcatctctcgaatgggctacgaccaccccagagatctcagcgatgtgcctgcttcagtaagatacctggagtcgaagcttgcggaattggatatcgagaaatgcttgagaataatcgatctgagctttgagatacataatgaggacttcaatttaaagactgatgattggaatgatttagttcgtttctcgaagagagattttgaccccgaagatccgcagcatgtgttcgaacttaaaactgttgcagggattttcgagtactactcgccgtacgtggaagtgagggcggtcgcgagccctgtggatgatccaacgattccagtagagactttccgtgcctatttcttggcgactttttgggtggttgttgggagtgccttgaccatgttcttttcggagagacagccttcaatcgctctcagtatatctgcggtgcagatgctggtgtatccctgtggactcctgtgggcgcgcttgatgccatgctggggcttcaacgtctatggccgcaggattgcactcaacatcgatagtccgtggaccgagaaggagcagatgtttgtgacgctgttgtacggtatcactactggctcgttctacgcgaactataatattttaacgcagcacattcactacagaagccctatgccatatgcgtatcaattgctactatcaattccactccagttcttggggtttggcttggctggaatcatgagaaaatacgtggtgtatccagcgactgctatgtggccatccataatgactacgatagcgctgaataaggcgatgatgagcgacgagcactcgggggggtttggtagaaaaaagatgttctacttgacttttgcaattattttcgtatacaattggtttccgacataccttttcgaagccttgagtacttttaactggataacttggataaaaccggataacttcaatcttgcgactgtcactggcggaattaatggcgtgggactgaacccactttcgacgttggactggactaacattggagtgggcggtttttatcttccattcagagtaacgctgactatgtatatgggaggtctacttgcagcactaatcactctcggcgtctattatatgaactacagtgaatgtcagtttcttccaattttcacgcaaagcttatataataacaaagcaaaagtgtaccaagtagaggaaatactgactgaagatcgattactcgatgagcagaagttccagaaatacggatttccatattatactgcaggtaacatggtggcgtatggttgttttatgtgcgtttacacagcgcttgtggtgagctccatcctgcagcagggggcattttatatgcgggtgtataaagcctggatcctagatctatggtcactgagaacgcgtagcgggttgcgtgaagccttcagtaacgaaaagcacgtgttagacgaattccacgacccacactgtcggatgatgaggaaatacaaagaagtacctgagtggtggtacatgtcaatatttgtggtttcaatcgtgattggagtcatcgtggtgacaacgttcaaaaccaatacacctgtgtggggattatttctagccgtaggcttaaacttcattctgcttcttccaattacgttactacaagccacgcgcggtgttactataggactgaacctgttgctgcaaatgatcagtggcctggcattgccaggaaatccttatgcgctaatgtttatcaaggcattcgggtataatattgatggccaaactgataactatctcagcaatatgaagatggcacactacgcgaaaataccacctatcccactatttaggggacagcttttaatggttctgatacaggtctttgtgaatcttggcgttataaattggcagcttcataatgttgagaactattgcgatcctaagcagcggttcaagttcacatgtcccggcgtcagaacatacttcaatgcttctgtcatgtggggtgctattggaccaagacgaatctttgaacatgtctatcctatcatgaaatggtgctggttaattggggcgtgcgtaggattattcttcggaatatggaagaggctcagtatcatgtacgacaaaataccgtaccctagacgtttcagtccggtgatcttcattattggcatgctttcttttggtcctccctataatttgcagtatagtacctctggtctctatgtgggcttcatttctatgttttacttgaaaagataccaccttcgtatatgggagaggtataattatgtcattgctgccgccatcacctgcggggtggtgttttctgctatcttgatgtttttctccgttcaatggaaggacattgaacttaactggtggggaaacagtatctcatatgcgggtcttgattacgctcgggtgccgcttcttaatgtgaccgaaactagagaggatactttggaccagagcttggccacattccgaaatagcctaagcgcgaacttttacaaactttccataatatga

SEQ ID NO: 56 - protein, 890 aa, Ashbya gossypii
MSKISEGVGDPPSYGSRSPSLSSHDKEKEKYNAGAEEQVTAEVLTDEQLVYLISRMGYDHPRDLSDVPASVRYLESKLAELDIEKCLRIIDLSFEIHNEDFNLKTDDWNDLVRFSKRDFDPEDPQHVFELKTVAGIFEYYSPYVEVRAVASPVDDPTIPVETFRAYFLATFWVVVGSALTMFFSERQPSIALSISAVQMLVYPCGLLWARLMPCWGFNVYGRRIALNIDSPWTEKEQMFVTLLYGITTGSFYANYNILTQHIHYRSPMPYAYQLLLSIPLQFLGFGLAGIMRKYVVYPATAMWPSIMTTIALNKAMMSDEHSGGFGRKKMFYLTFAIIFVYNWFPTYLFEALSTFNWITWIKPDNFNLATVTGGINGVGLNPLSTLDWTNIGVGGFYLPFRVTLTMYMGGLLAALITLGVYYMNYSECQFLPIFTQSLYNNKAKVYQVEEILTEDRLLDEQKFQKYGFPYYTAGNMVAYGCFMCVYTALVVSSILQQGAFYMRVYKAWILDLWSLRTRSGLREAFSNEKHVLDEFHDPHCRMMRKYKEVPEWWYMSIFVVSIVIGVIVVTTFKTNTPVWGLFLAVGLNFILLLPITLLQATRGVTIGLNLLLQMISGLALPGNPYALMFIKAFGYNIDGQTDNYLSNMKMAHYAKIPPIPLFRGQLLMVLIQVFVNLGVINWQLHNVENYCDPKQRFKFTCPGVRTYFNASVMWGAIGPRRIFEHVYPIMKWCWLIGACVGLFFGIWKRLSIMYDKIPYPRRFSPVIFIIGMLSFGPPYNLQYSTSGLYVGFISMFYLKRYHLRIWERYNYVIAAAITCGVVFSAILMFFSVQWKDIELNWWGNSISYAGLDYARVPLLNVTETREDTLDQSLATFRNSLSANFYKLSII

SEQ ID NO: 57 - DNA, 2394 bp, Saccharomyces kluyveri; identical to SEQ ID NO: 33

SEQ ID NO: 58 - protein, 797 aa, Saccharomyces kluyveri; identical to SEQ ID NO: 34

SEQ ID NO: 59 - DNA, 2664 bp, Saccharomyces kluyveri
atgtctgataataaggaaaagacagctggcactgtcaacatagttacgaatggcgacaacgaaacgattggtagcaactcttctagtttttcggagtcggcgatccccaacaaggaggctggaaccgtggtcgaggtggactctaaagggtatgccgaatcttgttctgacgaacagatggccaatttgttgaagaagatgggttacgaacgttgtgaggatatctcagagattccgcctgaaatcagatttgtatgcaccaaaattgaaaaactatctgtcgaggaagccgtggaaatcttgaaagaaggtgtcgaataccacgaggatgatccaaacattccatcgaacgagtacgccgaatatgtcagatttgcgaacggcgattatgaccatgaaaatgaaaaggagattttcgagttaaaggcccttgccgggttactcaaattccactctccgtatgctgaggtcagagctgttgtagaaccttctgataatcctacaatccctgtggaaactttcagagcttattttttggcccttgtttggggtatcgttgggtcaggctttaacgaatttttttcacataggttggtttccatttctatctccacttcagtcgttcaaatgttcctgtacttgtgtggtacgttatgggccaaacacctaccatgttgggggttcaccgtcaagggcaaaaggtttgctctaaacatcgaaactccgtggaccgacaaagaacagatgttcgccactctactgtttgccatatgtaacggtgtcttctacacccattacaacattttgactcagaagatatactacggcgataaaatctcttttggttaccaattctggctctcgatttgtatccagttcattgggttcggttttgcaggcatattgagaagatttgtcgtgtacccagctcgcaccctgtggccaacaagtatgtctaccattgcacttaacaatgctttattgagcagagaaaaagatgtttccaaaggactgtcgagatactcgttttttttcatcgctacaactttcatgttcttgtacacttggtttccaacctatttaatcaacatcttgaacaccttcaactggatgacttggattgctccaaataacttcgacttggctgcgataacaggtggtgtctctgggttgggcataaatccaatttcttcttttgattggaacgtcatcaacttcttatacccattggtaactccctttttctcctattccgtccaatttgcaggctcattctttgcagcattggttgttatagcggtttattataccaactataaggattgtcaatatctgccaattttttccaactctttgttcaccaatactggtacaccctactctatcaaaaaaatcctgaactctgactacaaagttgatgaagaaaagtaccaacagtactctccgccattctacagcgcagggaatctagtttcctacgggtcctttattgcagtataccctatgttgatcatatacgcattcatcaccgaatccaaggtactacttggcgcttgtaaagactgggcaaagggcatctggtccttaagaaaatggcaatcatggactaatatggcgaaacaggaataccatgcattagacagttttaatgatccacactcgaacatgatgaaaaaatacaaagaagttcctgactggtggtactttatgattttgctgatcagtatagtcatctctatcatagtcttggaaaaatatgagaccaacacccctatctgggctttgtttatgtctctaggtttcaactttgtctttttgatcccaattaccattttgcaagcgactacaggttttagcatcggcctaaacttactaatagaaatgatcattggttatgctttaccaggtaatccatacgctctaatgatcgtcaaagcctttggctataatatcgatggtcaagctgataattatgtgtccaacttgaaaatggcccattattgcaagattccacctgtagccttgtttagaggccagctgttcatggtgtttgttcaagttttagtcaatttaggggttttgaattggcaaatttctaatatcaaagatttctgccaaccaaaccaagcttcaaaattcacctgtcctgatgctaggacatactataacgcttctgtcatgtggggtgccatgggtccaaagaaaatttttaacgatgtctacccaattttgagatggtgctggctaattggcgcctgtctgggtgtctttttcggtttatggaaggtttatggccgtaggtattatccaacttggttcaatccaatcttgttcgttggtggtatgataaatatgggtcctccatacgggttgatgtatgtggttccgggtttctttgtgagctttttttcgcagttttatctcaaaaagtaccatttgcgtctttgggagaaatacaactacgtctgcgatgctgcattctctgctgggttagtgttctcatctatcgtcattttctttgccgttcaatataagcaaaaagatctaaactggtggggcaacacagtcatctatgctggtctagatggtgaaggtttagccaaaaaagacattagtcaaacttcaaagggttactttggtccagctcctggtcactacccatag

SEQ ID NO: 60 - protein, 887 aa, Saccharomyces kluyveri
MSDNKEKTAGTVNIVTNGDNETIGSNSSSFSESAIPNKEAGTVVEVDSKGYAESCSDEQMANLLKKMGYERCEDISEIPPEIRFVCTKIEKLSVEEAVEILKEGVEYHEDDPNIPSNEYAEYVRFANGDYDHENEKEIFELKALAGLLKFHSPYAEVRAVVEPSDNPTIPVETFRAYFLALVWGIVGSGFNEFFSHRLVSISISTSVVQMFLYLCGTLWAKHLPCWGFTVKGKRFALNIETPWTDKEQMFATLLFAICNGVFYTHYNILTQKIYYGDKISFGYQFWLSICIQFIGFGFAGILRRFVVYPARTLWPTSMSTIALNNALLSREKDVSKGLSRYSFFFIATTFMFLYTWFPTYLINILNTFNWMTWIAPNNFDLAAITGGVSGLGINPISSFDWNVINFLYPLVTPFFSYSVQFAGSFFAALVVIAVYYTNYKDCQYLPIFSNSLFTNTGTPYSIKKILNSDYKVDEEKYQQYSPPFYSAGNLVSYGSFIAVYPMLIIYAFITESKVLLGACKDWAKGIWSLRKWQSWTNMAKQEYHALDSFNDPHSNMMKKYKEVPDWWYFMILLISIVISIIVLEKYETNTPIWALFMSLGFNFVFLIPITILQATTGFSIGLNLLIEMIIGYALPGNPYALMIVKAFGYNIDGQADNYVSNLKMAHYCKIPPVALFRGQLFMVFVQVLVNLGVLNWQISNIKDFCQPNQASKFTCPDARTYYNASVMWGAMGPKKIFNDVYPILRWCWLIGACLGVFFGLWKVYGRRYYPTWFNPILFVGGMINMGPPYGLMYVVPGFFVSFFSQFYLKKYHLRLWEKYNYVCDAAFSAGLVFSSIVIFFAVQYKQKDLNWWGNTVIYAGLDGEGLAKKDISQTSKGYFGPAPGHYP

SEQ ID NO: 61 - DNA, 2433 bp, Kluyveromyces waltii; identical to SEQ ID NO: 35

SEQ ID NO: 62 - protein, 810 aa, Kluyveromyces waltii; identical to SEQ ID NO: 36

SEQ ID NO: 63 - DNA, 2418 bp, Saccharomyces kluyveri; identical to SEQ ID NO: 37

SEQ ID NO: 64 - protein, 805 aa, Saccharomyces kluyveri; identical to SEQ ID NO: 38

SEQ ID NO: 65 - DNA, 2634 bp, Saccharomyces bayanus
atgagcgaaaccgttaaagataatattataattaacgagaaggtatccccaaaggggactatcgattacactgatggagctgtgtacactgagagtctctccgatcattcatcggatactcctcaatggtatacggatgagcaattgctacacttcatgaaaaaattaggttacgcaaatcgtaccctttatgatatcccagatgacgtcaaatatatcgtcaaggaaatgccaaagctatcccttgaggattctttccaagtattaaaagatgctatcgtctattatgaagacgatgaaaacttacctcatgaccaatatgaagagtggaaaagattggctgaactggaatccccagattggaaagagcaattagatgaatacgatagcttcaacattagggcattcgcttctgctatcaaatttcattctccgtatcaagaggtcagagctgttgttgatccaagtgatgatcctactgttccagtagagacgttcagagcatactttttagcaatagtctggtccattgtcggttcaggtttcaatgaatttttttctcacagagtggtcacaattactttgggcacaccagttattcaaatgtttttatacatatgtggtaaagcttgggcaaaaacagttccctgctggggtttcactgtcaaaggtacaaagtatggtataaatatcaacacaccatggactcaaaaggagcaaatgtttgccactttactatacggtatttgccaaggcgctttttacacgcattataatattctgactcagaaaatattctatcattctagtttttcgtttggatatcaatttttgctatcgctagccgttcaatttataggatttggatttgctggaattcttaggagatttgttgtttatccatctcgtgctttatggccaacggttatgccaaccattgccataaataaggctcttttaggtaaagaaaagtacgaatctggtatgagcagatacaactttttctttttgacatttttcatcatgtttatctacaactggtttcccacttacattctcaatatcctaaacacttttaattggatgacctggataaaaccaagtaatattaatctagcaaatatcactggaagcgtcactggtattggaattaatcctatttcgtcctttgattggaatgttctttcatttaatagtccgttggttttcccattttggtcttacctaacccagtatcttggctctattttagcagctttaattgttgttgctgtgtactacagcaactatatgaactgtcaatttttgccaatgtttacaaattccttgtatactaatacaggtgagtccttcaaagtaactaagatattagacagcgaaaacaaattagatctgaaaaaatatcaaagttattcaccgccattctatactgctggaaatttggtatcgtatggtagttttatctgtgcatatcctcttatgattacatggtcatttattgtgcattcaaagcttttattgaatgcgtttaaagattgggctttaaacctgtggtctttaagaaaaccgaaatcctggactgcgatgttcaaaagtgagtatgcggctttggatgaatttgatgaccctcattctaatgcaatgaaaagttacaaagaagttccagattggtggtattttgcaatactattagcttcattagttgtggggatagctgttgttgaacattatccaactaatacgccagtttggggtctttttgtctccttaggtttcaacttcgttttcttgattccaactaccattttacaagcaaccactggcttttcttttggtttgaatttgctaattgaaatggtaatggggtatgctttaccaggtaacccagtcgctattatgatcctgaaagcttttggttacaacattgatggccaagcagacaattacgtttctaatctgaaaattgcgcattattgtaagattcccccaatggccgtatttagaggccaatgcgttatagttctgattcaaatatttgttaatttgggtgttttgaattggcagatctccaacatcaaggatttttgtacgcctcaccaaaatgcaaagtttacctgccccgatgcagtcacttactacaatgcttctgttgtctggggcgcaattgggccaaaaagaatcttcaatcacatttatccaatcttcaagtggtgttggttgataggtgcctgtattggtattgtatttggagtttggaaacgctggggtagattctatccaagggatttcgacccaatgttatttgtaggtggaatgattaatatgggtcctccatataatctaatgtacttcactcccggtatgattgtcagttttatttcccagtattacatgaagagacaccatttgaatttatgggagaagtacaattacgttttatcagcgggattttctactggtttggttctgtctgccatcatcatcttctttgcagtgcaatacaaagatacagccttcaattggtggggtaatacggttccctatgctggtgctgatggggctggttacccattgaaaaatatcaccgatacagcaaaaggatattttggtcctgatccaggtcattatccatga

SEQ ID NO: 66 - protein, 877 aa, Saccharomyces bayanus
MSETVKDNIIINEKVSPKGTIDYTDGAVYTESLSDHSSDTPQWYTDEQLLHFMKKLGYANRTLYDIPDDVKYIVKEMPKLSLEDSFQVLKDAIVYYEDDENLPHDQYEEWKRLAELESPDWKEQLDEYDSFNIRAFASAIKFHSPYQEVRAVVDPSDDPTVPVETFRAYFLAIVWSIVGSGFNEFFSHRVVTITLGTPVIQMFLYICGKAWAKTVPCWGFTVKGTKYGININTPWTQKEQMFATLLYGICQGAFYTHYNILTQKIFYHSSFSFGYQFLLSLAVQFIGFGFAGILRRFVVYPSRALWPTVMPTIAINKALLGKEKYESGMSRYNFFFLTFFIMFIYNWFPTYILNILNTFNWMTWIKPSNINLANITGSVTGIGINPISSFDWNVLSFNSPLVFPFWSYLTQYLGSILAALIVVAVYYSNYMNCQFLPMFTNSLYTNTGESFKVTKILDSENKLDLKKYQSYSPPFYTAGNLVSYGSFICAYPLMITWSFIVHSKLLLNAFKDWALNLWSLRKPKSWTAMFKSEYAALDEFDDPHSNAMKSYKEVPDWWYFAILLASLVVGIAVVEHYPTNTPVWGLFVSLGFNFVFLIPTTILQATTGFSFGLNLLIEMVMGYALPGNPVAIMILKAFGYNIDGQADNYVSNLKIAHYCKIPPMAVFRGQCVIVLIQIFVNLGVLNWQISNIKDFCTPHQNAKFTCPDAVTYYNASVVWGAIGPKRIFNHIYPIFKWCWLIGACIGIVFGVWKRWGRFYPRDFDPMLFVGGMINMGPPYNLMYFTPGMIVSFISQYYMKRHHLNLWEKYNYVLSAGFSTGLVLSAIIIFFAVQYKDTAFNWWGNTVPYAGADGAGYPLKNITDTAKGYFGPDPGHYP

SEQ ID NO: 67 - DNA, 2385 bp, Kluyveromyces lactis; identical to SEQ ID NO: 39

SEQ ID NO: 68 - protein, 794 aa, Kluyveromyces lactis; identical to SEQ ID NO: 40

SEQ ID NO: 69 - DNA, 2670 bp, Zygosaccharomyces rouxii
atggaaaaggaatcaaatagaggacaggtacatatcgaagaggatggctcctcgagtatcgataaggactttaagcccaataatggggtggttgagtactttgacgataagcagaatgctgaaatcttcgagactattcatccaacatccagtggggttaatgatgaccaaatggcggctctgttgaggaagttagggtatgaccatatggagagtatcactgatataccagctgacattcaatacgttgctggtaagattgcaacgatgagtcttgaagatgctgttgcagtgatgaaggagtctgccgtttaccataaggatgatcccaacattccacaggatgaattagatgaatatgttagattgtctgagttggacccggcgcttttagaacctcatgaacaggattactatgatttgatggcaatggctggtctattgcattggcactcaccttatagatctgtcagagcttgtgttgacccaagggatgaccctgatgctcccatcgaaactttcagatcctatactttggcgttaatttgggctattattggttcgggtttcaatgaatttttcgcacatagattgttgacaatcaccattaattctgctatggttcaaatgttgttgttccccatgggtaatttatgggccaaatttatgccctattggtcatttcccatttggaagggcaaaaggatccacattaattatccacaaccttggaatcaaaaggaacagatgttttctacaattttgtttgccatctgtagcactactttttacacccattacaacattttgacccaaaagatgtactaccatgaggctgttagctttggttatcaattctttttatcgattggtgtccaatatctaggtcttggatttgctggttctctgagaagatttgtgatttatccttcaaaagcaatttggccatctcaattacaaaccatggcactgaataaggcattgttcagcagacgtgaagagaaaaattctaaagggttaactcgtcaaacttttttctttatctgtactggattcatctttttttatcaatggatcccaacctatttattccaagcactttccacttttaactggatgacctggattaaacctgataatttcgatctagcaatggttactggttcggtgggcggtgttggttttaatccaattgcttcattcgattggaatgtcattaacaactatttttgtcttgtgacacctttgttttcatacatgtgtcaaatgatcggtgctctcattgctgcaatttgtgtccttgccatgtattattcaaaccaatacgactgtcaattcttacccatgttttccaatgctctctttaccaatacgggtgactcatttgaaattaacgctattctcaataagaaatacgaagtggatgtcaaaaaataccaaaactactctcccccatattacagtgccgggaatatcttttgttatggtgcgtttatcgcatcatacccattgttattcgcctattattttattagtgaatggaaaataatgtatggtgccttcaaagaatgggcattggcaatttgggcattaaccaaaaagcacacttggttacaagcttggaaagacgatgctcatgctttggaagagtttcacgatcctcactctagaatgatgcgtcgttacaaagaagttcctgattggtggtactatatggtcttgatctgtgcagttggtgttggtattggtactatcgaaggttatcatacaaacactccagtctggtcacttttcatgtcaatcggacttaacgcagcatttttgattccaattactattttagaagctacctcagctttacaaatgggtcttaacgttttgattgaagtcattatgggttatgcattacctggtaatccacatgccctaatgattatcaaggcattcggttacaacatcgatggacaggctgattcctttgtcggtaatttgaaattgggccactatgcaaaaattcctccaaaggcattgttccgcggtcaaatgttgatgattttagttcaaacctttgtttgtctcggtgttctcaattggtcaatgagtaacattaaggactactgtaagccacatcaagcatctaaattcacttgtccagacgctgtcacttattacaattcatctgtcctatggggtgctattggtccaaaacgtatttttgaaggtgtttaccctatcatgaaatggtgttggttgatcggcgctcttattggggttggatttggtctttataaactgctcctaccacgtttctaccccacatggtttaacccggttatcgttatcggaggtatgctaaacatggcaccaccatacaatttgacctatatgacaccaggtgccattgcaaatttcttttcacaattctacatgagacgttacagggttcgtttatgggaaaaatataactatgttctctctgcaggttttagtgctggtttagtcgtttcttccattatcatcttcttctccgtgcaatacaaaaacaaaccaattaattggtggggcaatgatgtgatcaatgccggccttgatgctgctggcccaccaaagaaaaatattaccttgacaccaaagggttacttcggtcctgatccaggccatttcccatga

SEQ ID NO: 70 - protein, 889 aa, Zygosaccharomyces rouxii
MEKESNRGQVHIEEDGSSSIDKDFKPNNGVVEYFDDKQNAEIFETIHPTSSGVNDDQMAALLRKLGYDHMESITDIPADIQYVAGKIATMSLEDAVAVMKESAVYHKDDPNIPQDELDEYVRLSELDPALLEPHEQDYYDLMAMAGLLHWHSPYRSVRACVDPRDDPDAPIETFRSYTLALIWAIIGSGFNEFFAHRLLTITINSAMVQMLLFPMGNLWAKFMPYWSFPIWKGKRIHINYPQPWNQKEQMFSTILFAICSTTFYTHYNILTQKMYYHEAVSFGYQFFLSIGVQYLGLGFAGSLRRFVIYPSKAIWPSQLQTMALNKALFSRREEKNSKGLTRQTFFFICTGFIFFYQWIPTYLFQALSTFNWMTWIKPDNFDLAMVTGSVGGVGFNPIASFDWNVINNYFCLVTPLFSYMCQMIGALIAAICVLAMYYSNQYDCQFLPMFSNALFTNTGDSFEINAILNKKYEVDVKKYQNYSPPYYSAGNIFCYGAFIASYPLLFAYYFISEWKIMYGAFKEWALAIWALTKKHTWLQAWKDDAHALEEFHDPHSRMMRRYKEVPDWWYYMVLICAVGVGIGTIEGYHTNTPVWSLFMSIGLNAAFLIPITILEATSALQMGLNVLIEVIMGYALPGNPHALMIIKAFGYNIDGQADSFVGNLKLGHYAKIPPKALFRGQMLMILVQTFVCLGVLNWSMSNIKDYCKPHQASKFTCPDAVTYYNSSVLWGAIGPKRIFEGVYPIMKWCWLIGALIGVGFGLYKLLLPRFYPTWFNPVIVIGGMLNMAPPYNLTYMTPGAIANFFSQFYMRRYRVRLWEKYNYVLSAGFSAGLVVSSIIIFFSVQYKNKPINWWGNDVINAGLDAAGPPKKNITLTPKGYFGPDPGHFP

SEQ ID NO: 71 - DNA, 2658 bp, Ashbya gossypii
atggagaagttgtcgggagaatttaaagggtctcctccgtacttcaatgaagacaaggatagcagctcgctatcaccaagtttacctagtcaagacgataaaaagtacaaatacaatgtttctgcagacgcacaagagaccaaagaggtcctgactgaggatcaattgatatatatcactactcgaatgggctatgaacacgctacagatctcgagcatatccctgaatcagtaagatacctagagtccaagcttgcggacttggatgtcgaaaagtgctgtgaaattattgatgtacatatcaaggagcacgatcaggacccaaatttaagtactgaggattggaatgatctagttcgtttctctaagagagattttgaccccaaaaatccgcagcaggtgtttgaacttaaagttgttgcagctatctttcattattattcgccatacgtggaagtgagggcggtcgcaagccctgtggatgatccgaccattccagtagagactttccgtgcttatttcttggcgactctttgggtggttatcggtagtggtttcaacatgttttttgcgcagaggcagccagcaatcagtcttggagtatttgccgtgcaaatgctggtatatccatgtgcagttttgtgggtgcgcgtgatgccatgctggggtttcaaagtctttggtcgcagaattgcgctcaacattgagtctcagtggagtgagaaggagcagatgtttgtgacactgctgtacagtatcaccaatggcgcattctactctgaatataatattgtaacacagcaaattcactacaaaagccctatgtcatatgcatatcaatttctactatcattttcacttcagttcttggggtttggattagctggaatcatgagaagatatgtcgtgtatccatcaattgccctttggccatccagtatgactactatagccctaaacaaggcactactaagctccgaccactcgaatggtattggtagaaaaaaaatgttttacattactgcgacggccatatttgtatacaattggtttccgacataccttttcgaagccttgagtacctttaactggatgacttggataaagccagataacttcagtcttgcaactgtcaccggtgggattaatggcgtgggactgaacccaatttcgactttcgattggacgaacattggaacgagcagcctttacctcccgttcagagtaacactgactacgtatttgggaggcctacttgcagcactagtcactcttggcgtctattatatgaattacagagaatgccagtttcttccaatattcacgcaaagcttatataataacagagcaacatcgtaccgggtagaagaaatactgactgaagatcgaaagctcgacgagcagaagttccagaaatatggatttccatactatactgcaggtaacattgtggcatatgggtgttttatgtgcgtttacaccgctcttgtagtgacatccattctgcagcagggggcattttatggacgggtgtataaaacttggatcctagatttatggtcgctgagaaagccgagctcatggcgtgcagtgttcagtaatgataagcacgtgctagacgatttccacgattcacacagtcggatgatgaggaaatacaaagaggtacctgaatggtggtacatgactatattcatagtttcaattgtaattggaatcattgtggtgaaagtattcaaaacaaatacacctgtgtggggattatttctagcagtagctttaaattttgttctgttacttccaatcacgttactacaagcgacgcgcggtgttactataggactgaacctgttgctgcagatgataagtggcctggcactaccgggaaatccctatgctctaatgtttatcaaggcctttgggtataatattgatggccaagctgataactatcttggcaatatgaagttggcacattacgcaaagataccacccgttccactatttcggggacagcttttaatggttctgatacagatctttgtgaatcttggcgttatcaattggcaacttcataatattgagaactattgcgatcctaagcagcggttcaagtttacgtgtccgggaattagaacatacttcaatgcttctgttatgtggggtgctattgggccaaagagaatttttgaacatgtctatcctatcatgaaatggtgctggttaattggggcgtgcgtaggattgttcttcggactatggaaaaagctcagtatcatgtacaaaaagataccctaccctgaccggtttagtccggtaatatttatcattggaatgctttcttttggtcctccctacaatttgcagtatactacctctggtctctatgtgggcttcatttctatgtgttacatgaaaagataccaccttcgcgtatgggaaagatataactatgtcgttgctgctggtatctcctgtggtttagtgttttctgctatcgtgatgttcttcaccgttcaatggaagggtgtcgaaatatcatggtgggggaatacggtttcatatgcgggtcttgattacgctcgggtaccgcttctcaatgtgactgaaacagagagaggatactttggaccagaacttggccaaattcctgggtag

SEQ ID NO: 72 - protein, 885 aa, Ashbya gossypii
MEKLSGEFKGSPPYFNEDKDSSSLSPSLPSQDDKKYKYNVSADAQETKEVLTEDQLIYITTRMGYEHATDLEHIPESVRYLESKLADLDVEKCCEIIDVHIKEHDQDPNLSTEDWNDLVRFSKRDFDPKNPQQVFELKVVAAIFHYYSPYVEVRAVASPVDDPTIPVETFRAYFLATLWVVIGSGFNMFFAQRQPAISLGVFAVQMLVYPCAVLWVRVMPCWGFKVFGRRIALNIESQWSEKEQMFVTLLYSITNGAFYSEYNIVTQQIHYKSPMSYAYQFLLSFSLQFLGFGLAGIMRRYVVYPSIALWPSSMTTIALNKALLSSDHSNGIGRKKMFYITATAIFVYNWFPTYLFEALSTFNWMTWIKPDNFSLATVTGGINGVGLNPISTFDWTNIGTSSLYLPFRVTLTTYLGGLLAALVTLGVYYMNYRECQFLPIFTQSLYNNRATSYRVEEILTEDRKLDEQKFQKYGFPYYTAGNIVAYGCFMCVYTALVVTSILQQGAFYGRVYKTWILDLWSLRKPSSWRAVFSNDKHVLDDFHDSHSRMMRKYKEVPEWWYMTIFIVSIVIGIIVVKVFKTNTPVWGLFLAVALNFVLLLPITLLQATRGVTIGLNLLLQMISGLALPGNPYALMFIKAFGYNIDGQADNYLGNMKLAHYAKIPPVPLFRGQLLMVLIQIFVNLGVINWQLHNIENYCDPKQRFKFTCPGIRTYFNASVMWGAIGPKRIFEHVYPIMKWCWLIGACVGLFFGLWKKLSIMYKKIPYPDRFSPVIFIIGMLSFGPPYNLQYTTSGLYVGFISMCYMKRYHLRVWERYNYVVAAGISCGLVFSAIVMFFTVQWKGVEISWWGNTVSYAGLDYARVPLLNVTETERGYFGPELGQIPG

SEQ ID NO: 73 - DNA, 2610 bp, Kluyveromyces lactis
atgcaatctgatgaggcgtctttgaaaaaagattatcaattcaatattcaggagaaagaaagtagtactgataatggtaatttagaagagttcgaagactacggtgtagaatttaccaatgctattgttgaagcttgcggccatgatccagaatcattcccagatggtatctacccgaaagaagttgaatatatgatcactgtgacaaagcgtttatcgatcgaggagtctttaaagattttagaaaagactttgaaagaacatgaggatgacgcaaatttaccagaagatttgattgaaagaactcgttctctgctcgatagggatgactacttgaaacagggtcatagtgagttcgaatggttcgaacagtgtaaaattgatgcagcaatgatccactaccattctccttatccagaagtcagaacagtcacttctccgatagatgatgaaactattcccatcgaaacttttagagcttacttcttgggcttcttttggaccatcttgggtgctggtgtcaatgaatttttcgtgcatagaaagccaaaaatctctttaacggccccagtgatgcagatcttgttatatccatgtggtaaattatttgaaagagtgatgcccaatcatactttcaagttaggtaagatttccgtcaatttcaatccaggaccgtggtcgttcaaggaacagatgttttccactattattttcaatgtcgctacaagttacacttacgtttcccataacatttatgtgcaaagattagaaatcttctacaacaataaatggctagatttcggttatgaagtattgttaatgctatgttcacaactgctcggtttcggctacgcaggtatactcagaaaatttgtcatctacaatgaaaagtgcatatggccaacgttgttcccaactttggctcttaatggggcccttttgaaacctgattctaaggaaaacatcaacggttggcgaatgacccgttacaagttttttctgacattcttcgtcattatgtttatttacaattggattcctacttatttgttcgaaggtttatccactttcagttggttgacctggtgttctcctaaaaacttcgatcttgctgtagtcacaggaagccaatacgggctaggactgaaccctgttcctacctttgattggaatatcattgattataactacgcccttactatcccattcttttctcaattgaatcaatacattgggacgtttattggattctttgctatattaggcatatattattcaaactataaatggacagcctttttaccattaaattcaaatgatatcttcactaatagaggagagtcttatgtcgttcaagacatattggatgaaaattcaatgcttgtggagtcaaaatatcaggagtattctccaccgtattactctgctggtaatttgttggtctacggtggtatcttcgctcaatatccatttgcatttctttatgtcttcttcaccgaatgggcatccatattacaatgcttcaaacaaatgtacagacagatcaaaaatttccgaaacgttagcatcaaaagttcaacttatgatggctttgatgacccacaaacaaggttaatgaaaaagtacaaggatgtacctgattggtggttcctggtcgttttagttgttgctttggttctgggtatcttatgcatcaaactgtacccaactcaaactcctgtatgggggttattcttcatccttggaattaactttgtgtttttaattccaatctgctttatattctccatgacagggttcaacatgactatgggtgtgatcactgagatcattattggttatgctcttcctggtaacggtttagctttaatgacgttaaaatcgttgggttacactatagacaaccaagcagagtcatacattgctgaccaaaagttggcacattacgctaagattccacaacgcgctgtcttcaaaggtcaattagtcggcgttttaattcaatgttttgtctctttaggtgttattagttggcaaatagtcaatgtgaaagacatctgtacgtcgaaagcagaaaacaagtttacttgtccaaaggaggttaacttttactcttcttctgtgttttggggtgtcatcggccctaagagagtgtttaacggattatatccaatcttgaaatatacattcttaattgggttcttgttatgcctattgtgttgtgctatcaagtatttcttcccaagacaaacgaggctattccatccaacaatcttaattggtggtatgcaacaatttgctccttacaatttatcttatgtgactgccggtttgtacttctctttcggattcatgttctacatcaagaggtactacactaaatggtgggaaaagtacaattacgtgcttgctgctgcgttctcatctgccgttgccttttctgcaatcattatcttcttttccgttaaatataaaccaaagcccattgactggtggggaaacaatattgttggcgtcggtgttgatggtggagaggggaggcagactctcaaaaatataacgagtgcttttgacggttatttcggtccaagaaaaggttcatatccataa

SEQ ID NO: 74 - protein, 869 aa, Kluyveromyces lactis
MQSDEASLKKDYQFNIQEKESSTDNGNLEEFEDYGVEFTNAIVEACGHDPESFPDGIYPKEVEYMITVTKRLSIEESLKILEKTLKEHEDDANLPEDLIERTRSLLDRDDYLKQGHSEFEWFEQCKIDAAMIHYHSPYPEVRTVTSPIDDETIPIETFRAYFLGFFWTILGAGVNEFFVHRKPKISLTAPVMQILLYPCGKLFERVMPNHTFKLGKISVNFNPGPWSFKEQMFSTIIFNVATSYTYVSHNIYVQRLEIFYNNKWLDFGYEVLLMLCSQLLGFGYAGILRKFVIYNEKCIWPTLFPTLALNGALLKPDSKENINGWRMTRYKFFLTFFVIMFIYNWIPTYLFEGLSTFSWLTWCSPKNFDLAVVTGSQYGLGLNPVPTFDWNIIDYNYALTIPFFSQLNQYIGTFIGFFAILGIYYSNYKWTAFLPLNSNDIFTNRGESYVVQDILDENSMLVESKYQEYSPPYYSAGNLLVYGGIFAQYPFAFLYVFFTEWASILQCFKQMYRQIKNFRNVSIKSSTYDGFDDPQTRLMKKYKDVPDWWFLVVLVVALVLGILCIKLYPTQTPVWGLFFILGINFVFLIPICFIFSMTGFNMTMGVITEIIIGYALPGNGLALMTLKSLGYTIDNQAESYIADQKLAHYAKIPQRAVFKGQLVGVLIQCFVSLGVISWQIVNVKDICTSKAENKFTCPKEVNFYSSSVFWGVIGPKRVFNGLYPILKYTFLIGFLLCLLCCAIKYFFPRQTRLFHPTILIGGMQQFAPYNLSYVTAGLYFSFGFMFYIKRYYTKWWEKYNYVLAAAFSSAVAFSAIIIFFSVKYKPKPIDWWGNNIVGVGVDGGEGRQTLKNITSAFDGYFGPRKGSYP

SEQ ID NO: 75 - DNA, 2634 bp, Ashbya gossypii
atggactttcaacaggtggataccaaagaaaagaactccgacaggttaccatccccttgtgctccggcctctgagaaagatggaaaggctggctcgcaggatgtgccattgtccgacactcaggaactttcgctgctagacgatgaacaccttattctccttcttcacaagatgggctacaaacacgcggacttggaagatattccgccggttgttcactatcttgtagcacggataaatgaattgacaatagaaaagtcactgacgatattgaaaaagtgtgccgttgaccacgctggtgatccgaatatcacggaggaggaagctaccgacctagagcgctttacttctggcgactttgaccacaccgatgagacagaagtctttcagttgaagctacttgctgcattattctactaccactcgccctatcccgaggttcgggcggttgtgggtcccggagatgatcccactatcccagtggaaacgttccgctgttacttcctgaccaccaccattactattattggctgtggactgacaacctttttccaatcccgttatccgttaatcgaattctcctcgatggcggcgcagtttttgttcttcatactgggaacgttatggtcgaaatttatgcctgcagttaggatacccatatttccaggttatggtttccaattgaatttgcagacttcttggtccaagaaggaacaaatgtttgccacgctgctgtacagtattactacaggcgtcttctattcttattttaatatcttgacgcaagatatgttttataatgatcccacatcgttagggttccaaataatcctatctctatcgctacagttcatggggttcggacttgcgggtcttctgaggcctttcgtggttttccccgcacgcgcactttggccattatctatgcccacaatagctttgaacaatgcactacttgcccaagatgtgggaaaaggtactagtatcaggaaagttttcttttactttggaattggcatgtttatctacaactggttcccgacggtttttgctgatgtgctcagcaacctgaattggctaacctggattaagccaaataacttcaatctcgctgccattactgggggcaggtacggtattgctacaaacccattgcctaccttagattggaattatatcacacattgggcattggcgttaccattttatactgttttcttgcaatatctcgggtccttactttctgttgtgattataatagcagtttactacactaactacatggaatgtcagtatttgccgatatttggtcaaccattgtatagtaacgaaggaaagtttttcgacgccagtaaagtgcttactgattttaaattagactggcaaaaataccaacagtattcactgccatactattcagctggaaatattgttggatatggctcgtttatttctctatacacgctccttgctgcatacagtattatcacagagtatgaaattctaggtggcgcttgcaaacgattgggggttggattgtggtctctaacgaagttagatacttggaggaatcttcacaaaaatgactcctctatccttgagggttacgacgatgcacactgccgcgaaatgcgcaagtacccggaagttcccgaatggtggttctttgctatcttccttatatctctggtattggcgattatattggttactacatacaagaccaatacacctgtgtggggcatcttcttggctgttggtctcaatgttgcattcttattaccactaacaactcttcaatcaacgacaggtgcaagtctcggtctcaatttgctcgtgcagatgataacaggttacttgcttcccggaaacccttacgccctcatgatcatcaaagcttttggttataacatcgatggccaagccgacaactacttatcaaatctgaaaatggctcactattgcaaaatacctccagtgcctctattccgcggtcaattgtccatggtgctgctgcaggtcattgtcagtcttgctgttattaattggcagattcataatgtccctgatttctgtaatccaaaaaacagaagcggctttatttgccaaggccccaggacatactacaatgcgtctattgtatggggaataattgggccaaagaaggtgttcagctacttatacccgatgatgaaatggtgttggctaattggtgcactgttaggagtgcttttcggaggctggtgccgcttgtctaggaaatacaaactctattatccacgcagcttcaatccggtggtctttgtgacaggtatgatttcattgatgcctccgtataacctaagagtttacacatccaagctttatgtggcctttattggccagtattggctcagaaggtatcatctgcgaatttgggaaaaatacaactatgtggttgctgcagccttcaactgtggagttatattttcagctatcacgatattctttgcgatacaatatccagaaataagattagactggattctcaatacgattaacgatgttggtatcgatgcaacccctacacctctaaaagatgtcaaacttaccgaaagaggttattttggcccaccccgggggagccttccttag

SEQ ID NO: 76 - protein, 877 aa, Ashbya gossypii
MDFQQVDTKEKNSDRLPSPCAPASEKDGKAGSQDVPLSDTQELSLLDDEHLILLLHKMGYKHADLEDIPPVVHYLVARINELTIEKSLTILKKCAVDHAGDPNITEEEATDLERFTSGDFDHTDETEVFQLKLLAALFYYHSPYPEVRAVVGPGDDPTIPVETFRCYFLTTTITIIGCGLTTFFQSRYPLIEFSSMAAQFLFFILGTLWSKFMPAVRIPIFPGYGFQLNLQTSWSKKEQMFATLLYSITTGVFYSYFNILTQDMFYNDPTSLGFQIILSLSLQFMGFGLAGLLRPFVVFPARALWPLSMPTIALNNALLAQDVGKGTSIRKVFFYFGIGMFIYNWFPTVFADVLSNLNWLTWIKPNNFNLAAITGGRYGIATNPLPTLDWNYITHWALALPFYTVFLQYLGSLLSVVIIIAVYYTNYMECQYLPIFGQPLYSNEGKFFDASKVLTDFKLDWQKYQQYSLPYYSAGNIVGYGSFISLYTLLAAYSIITEYEILGGACKRLGVGLWSLTKLDTWRNLHKNDSSILEGYDDAHCREMRKYPEVPEWWFFAIFLISLVLAIILVTTYKTNTPVWGIFLAVGLNVAFLLPLTTLQSTTGASLGLNLLVQMITGYLLPGNPYALMIIKAFGYNIDGQADNYLSNLKMAHYCKIPPVPLFRGQLSMVLLQVIVSLAVINWQIHNVPDFCNPKNRSGFICQGPRTYYNASIVWGIIGPKKVFSYLYPMMKWCWLIGALLGVLFGGWCRLSRKYKLYYPRSFNPVVFVTGMISLMPPYNLRVYTSKLYVAFIGQYWLRRYHLRIWEKYNYVVAAAFNCGVIFSAITIFFAIQYPEIRLDWILNTINDVGIDATPTPLKDVKLTERGYFGPPRGSLP

SEQ ID NO: 77 - DNA, 2445 bp, Kluyveromyces thermotoleran; identical to SEQ ID NO: 29

SEQ ID NO: 78 - protein, 814 aa, Kluyveromyces thermotoleran; identical to SEQ ID NO: 30

SEQ ID NO: 79 - DNA, 2397 bp, Zygosaccharomyces rouxii; identical to SEQ ID NO: 31

SEQ ID NO: 80 - protein, 798 aa, Zygosaccharomyces rouxii; identical to SEQ ID NO: 32

SEQ ID NO: 81 - DNA, 2649 bp, Kluyveromyces waltii
atgccgaaagagaagtctgagactataaccagtgaccgcgcaagcagttctagtgacggtcagaatagttacgttgatggcacatgggacaaggaaaaacagatcatcactaccgtagagtcccaaggttccatcaaagatttctctgacgaggaaattagccacttgttaaagaagctaggatatgatcgccccgaagatacatctgatattccgcccgaaatcgaatacatcgggagcaagatcagcaacttgaccgtcgaagactcacttcaaatcctgaagaaagcagtcgttgattatcaagatgaccccaacattccttctgatgagtatgcagaaatccaaaggctggcaagctttgaaaagctagaggtgcacaacgctaatgaaatctttgaattaaaagcattggcgggtctgctaaaatatcactcgccatacaaagaagttcgggcaacagttgatccccgcgatgatcctaacattccggtcgagacttttagatcctactttctggctcttgtttgggccataatcggttcgggcttcaacgagttcttttctcataggctggtatcaatcagtttatcaacctcagtcattcagatgttcttgcttccatgtggcaagttttgggagaagtacgttccaaaagttggattccccatctggaaaggtaaaagaataaaccttaacatcgactcaccttggagtgcaaaggagcagatgttttctaccctattgtttgcaatttgtatgggtactttctacacgcactataacattctgactcttaaagtttattacaacgatgacgttgattttgggtatcaattttggctctcaatgggagttcagtttatgggatttggatttgccggtttgttgagaaaatacgttgtgtatccagcaagggctatttggccgggcagtttgcagacactcgccttgaataaagctcttttcaaagattcaggttccaagaaaggaaaaggattggcaagtcaaacctttttctttttatctgtggcatttatgttcttttacacctggataccgacatatctgatgaactttttgagtatgttcaattggatgacttggattgctcctgataacttcaacttagccatggtaactggaagcgttagtggactaggcttcaacccaatttcttcatttgactggaatgtgattgattttcttggagctcttaccactcctttcttctcgtactttactcaactcgcggggggtattctatccgctctaatagtcattgcaatctactggtctaactattacgactgccaatatcttcccatattctccaactccctgttcacaaacacaggagagagatttaaaataactaagatactgaactcggagtggaagcttgacccacagaaatatcaggaatattctcccccatatttctcagctgggaacattgtaacttatggcacttttattgccatttatccactattgatcgtgtatgcgctcttctcagaaacgaatgtgctctttggggccgtcaagggttggtttagtgacatcttctctctattcaagaaagatacatggagaaattggaacgccgaaacgaataagctagatgaatttgatgatgcgcacagtagaatgatgaaacagtataaagaggttcctgactggtggtatttcgtgatttttttggtttctctaatcatagggatttgtttcattgaaagatatcacacaaacactcctgtatgggctcttcttatgtccatcggattcaattttgtgtttttgattccccttactacgttgcagtccgtaacaacattctctttaggactgaacgtcttgattgaaatgatagtgggttatgctctgccaggaaatccacaggccctgatgattataaaagcatttgggtacaacattgatggacaagctgataattatgtctcaaacttgaagatgggtcactatgccaaggttccacctgttgcgttattcagagggcagctgataatggtttttgttcagattttcgtgaaccttggagtcttaaactggtccatctccaatataaaagacttttgcatgccaacacagtctgccaagttcacatgcccagatgcgacaacctactataattcatctgtcatgtggggagcactaggtccaaagaagattttcaacgacgtttacccgatcatgagatggtcttggctgattggcgcatgtattgggttattctttggtgtttggcggaaattttttaggagatattacccaacttggttgaaccctgttttgatcgccggcggtatgttgaatgtgtcaccaccttatggtttgacttacgtgatacccggggcaattgctaatttcttctcacaattttactataaaaggcgccatgtccgtttgtggtcaaagtttaactatgtgttaagtgccggattctctgcaggcttggtattttcctccattgttatattctttgcagttcagtacaaaaactacgatctcaattggtggggaaatactgtgccctacgctgggttggatggcgcagaacctccgatgaaggacgtaagtttgacaccaaagggacattttggcccggatcctggtcattacccataa

SEQ ID NO: 82 - protein, 882 aa, Kluyveromyces waltii
MPKEKSETITSDRASSSSDGQNSYVDGTWDKEKQIITTVESQGSIKDFSDEEISHLLKKLGYDRPEDTSDIPPEIEYIGSKISNLTVEDSLQILKKAVVDYQDDPNIPSDEYAEIQRLASFEKLEVHNANEIFELKALAGLLKYHSPYKEVRATVDPRDDPNIPVETFRSYFLALVWAIIGSGFNEFFSHRLVSISLSTSVIQMFLLPCGKFWEKYVPKVGFPIWKGKRINLNIDSPWSAKEQMFSTLLFAICMGTFYTHYNILTLKVYYNDDVDFGYQFWLSMGVQFMGFGFAGLLRKYVVYPARAIWPGSLQTLALNKALFKDSGSKKGKGLASQTFFFLSVAFMFFYTWIPTYLMNFLSMFNWMTWIAPDNFNLAMVTGSVSGLGFNPISSFDWNVIDFLGALTTPFFSYFTQLAGGILSALIVIAIYWSNYYDCQYLPIFSNSLFTNTGERFKITKILNSEWKLDPQKYQEYSPPYFSAGNIVTYGTFIAIYPLLIVYALFSETNVLFGAVKGWFSDIFSLFKKDTWRNWNAETNKLDEFDDAHSRMMKQYKEVPDWWYFVIFLVSLIIGICFIERYHTNTPVWALLMSIGFNFVFLIPLTTLQSVTTFSLGLNVLIEMIVGYALPGNPQALMIIKAFGYNIDGQADNYVSNLKMGHYAKVPPVALFRGQLIMVFVQIFVNLGVLNWSISNIKDFCMPTQSAKFTCPDATTYYNSSVMWGALGPKKIFNDVYPIMRWSWLIGACIGLFFGVWRKFFRRYYPTWLNPVLIAGGMLNVSPPYGLTYVIPGAIANFFSQFYYKRRHVRLWSKFNYVLSAGFSAGLVFSSIVIFFAVQYKNYDLNWWGNTVPYAGLDGAEPPMKDVSLTPKGHFGPDPGHYP

SEQ ID NO: 83 - DNA, 2769 bp, Zygosaccharomyces rouxii
atgcttaacaaattttggcacaccaaaggtccgagtgtgcaagagggggaagaaaaagaagaagaatatcaagatgtgtttgagggagttgagatgaatggtgaaaataagcctgaagtgaagcatgaggtccgcgaaactaacagttccattgaatcagaaaaagtggatggcgactttggaaatactacaaattattactctgataaaccagaaattggtgtagttgaaactataatctcaccatcaggtaaagtgagtgatgaacaatggactgtccttttgaaaaaggcagggtttgataatcctgataacataactgacattcctgctgatttgaaatatgtggctagtcaaattgttaacatgtcattagaagaagcagctgaagttttaaaattaggcgccgaataccatgcagatgatcctaatttgtctagtgatgaatacaacgattttgttaaactctcagagctcaatcccgttactttacatccttttgaagaagatgctctagagttaaaagctgttgcaggattacttcatttccactcaccttataaagcagtcagagcttgtgttagtccccaagatgattatgagagtccagtggaaacctttaggtcttattttctagcattagtttgggccattattggatctggtttcaacgaattttttgcccatagattaatggttattacaatttcttcgtctatggttcaattgttacttttccccatgggtagtctttgggccaaaattatgccatattggtcttttccaatttggaaaggtaagagaattcacctcaatattccacaaccttggtcacaaaaggaacaaatgttttctacagttttattttcgattgcggttagctctttttacatggacagtgttattttaaccctgaaaatgttttacaaggaaaaagtaagttttggttatcaatttttcacttcaatagcggttcagtttttaggttttggatttgcgggctcattacgtcgtttcgttatttacccatcacatgccatctggccgagtcaattacaaactatggcattgaacaaagcattgttcagtaaaaaaactgaaaagggtggtcgtggtttaaccagtcaaacttttttctacatctgtgtcgcatttacttttttttacgaatggttaccaacatatctattccagatattaagcacattcaactggatgacttggattaaacctgataatttcaatttggcaatggtaacgggatctatgggtggtgttggtataaatccaattgcatcatttgattggaatgtgattaactattacagtgctctggtcacgcctcttttttcatatgctaatcaaatggcaggtggtttgatagcggctatttgcgtcttagcgatctattattctaaccaattcgactgtcaatatttacccatgttttccaatgcactattcactaatacaggaacagaatacgatgtcacaagtattattaacagtaaagctgaagtcgatgttaacaaatatcaaaattattcacccccatattatagtgctggtaacttattctgttatggtgtcttcattgcctcttatccactactatttgcctattcattccttacccaatggaaagttctattgagggcttttaaagattgggcaagtgcaatttggtctttaaccaagaaacatacttggttatattcttggagagaaagttcacatgcattagaagaatttcatgatcctcattcaagaatgatgcgccgttacaatgaagtccccgattggtggtactacattgtcttaatcctatcaatcgttattggaattgctgcacttgaagggtaccatacaaacaccccgatttggtcacttttcatggcagttggattaaacgcagtattcttgatcccaattaccatcttagaagctaccactgcattgcaattaggtttgaacgttttgatcgaaatcattatgggttatgcgttacctggtaacccacaagcattaatgcttatcaaggcatttggttacaacattgatggtcaagccgattcttatgttggtaatctaaaactaggtcattactctaaaattcctccaatggcgttgtttagaggccaaatgtttatggttttaatacaaactctggtttccctaggtgttctaaactggtcaatcagtaacattaaagattactgtcaaccaaaccaagaatcgaaattcacttgtccagatgctatcacttactacaatgcatctgtcctctggggtgctattggtcccaaacgtatttttgaaggtgtttaccctattttgaaatggtgttggctaatcggagctatcatcgggatcggattgggtctgtggaaactactgatcccccgtttctatcccctctggtttaatccattattagtcgttggcggtatgctaaacatggcaccaccgtacaatctaacatatatgactccgggtgccattgccaattttttctcacaattttacatgcgcaagtatcacctaagaatatggcaaaaatataactatgtcttagtggcaggtttccaaacaggcttagtcatatcttcaattattatattcttttctgtccagtacaaagaaaaacctatcagttggtggggcaatgacgttattaacaacggtcttgatgctgcaggtccgccgaagaaaaacgtttcactaactccgagaggttattttggtccagaatacggccattttccgtga

SEQ ID NO: 84 - protein, 922 aa, Zygosaccharomyces rouxii
MLNKFWHTKGPSVQEGEEKEEEYQDVFEGVEMNGENKPEVKHEVRETNSSIESEKVDGDFGNTTNYYSDKPEIGVVETIISPSGKVSDEQWTVLLKKAGFDNPDNITDIPADLKYVASQIVNMSLEEAAEVLKLGAEYHADDPNLSSDEYNDFVKLSELNPVTLHPFEEDALELKAVAGLLHFHSPYKAVRACVSPQDDYESPVETFRSYFLALVWAIIGSGFNEFFAHRLMVITISSSMVQLLLFPMGSLWAKIMPYWSFPIWKGKRIHLNIPQPWSQKEQMFSTVLFSIAVSSFYMDSVILTLKMFYKEKVSFGYQFFTSIAVQFLGFGFAGSLRRFVIYPSHAIWPSQLQTMALNKALFSKKTEKGGRGLTSQTFFYICVAFTFFYEWLPTYLFQILSTFNWMTWIKPDNFNLAMVTGSMGGVGINPIASFDWNVINYYSALVTPLFSYANQMAGGLIAAICVLAIYYSNQFDCQYLPMFSNALFTNTGTEYDVTSIINSKAEVDVNKYQNYSPPYYSAGNLFCYGVFIASYPLLFAYSFLTQWKVLLRAFKDWASAIWSLTKKHTWLYSWRESSHALEEFHDPHSRMMRRYNEVPDWWYYIVLILSIVIGIAALEGYHTNTPIWSLFMAVGLNAVFLIPITILEATTALQLGLNVLIEIIMGYALPGNPQALMLIKAFGYNIDGQADSYVGNLKLGHYSKIPPMALFRGQMFMVLIQTLVSLGVLNWSISNIKDYCQPNQESKFTCPDAITYYNASVLWGAIGPKRIFEGVYPILKWCWLIGAIIGIGLGLWKLLIPRFYPLWFNPLLVVGGMLNMAPPYNLTYMTPGAIANFFSQFYMRKYHLRIWQKYNYVLVAGFQTGLVISSIIIFFSVQYKEKPISWWGNDVINNGLDAAGPPKKNVSLTPRGYFGPEYGHFP

SEQ ID NO: 85 - DNA, 2406 bp, Saccharomyces bayanus; identical to SEQ ID NO: 41

SEQ ID NO: 86 - protein, 801 aa, Saccharomyces bayanus; identical to SEQ ID NO: 42

SEQ ID NO: 87 - DNA, 3084 bp, Saccharomyces kluyveri
atgcgtctagtactcagtgttttatgtatttctacgctgctgggaggttttgttcaaggagagtctgtaataaaagatgaacgttttgctgtctctataccgccaagacacggaaacgacaacttcggtgacgaagataagtgcccaccatgcttcaactgcatgctgccaatgttcgagtgtaaacaattctcgaaatgtaactcttacagtggaaagtgtgaatgcttagatggatttggtggtgaggactgttctcagccgttatgtggtgctctctctgatggaaacagccagaggcctataagaggcaacgaaacagaaacctgtgaatgtaaagacggttggggtggtatcaactgtaatatttgtaaagaagattttgtgtgcgatgcctttatgccagatgatctgaagggtacttgctataaaaatggtatgattgtaaacaagtttcaccaaggatgtgatgtcacaaacaaaaaaatcatacagatcttgaatggccggaaacctcaggttacattctcctgtaataagacggcagaggtttgtgatttccaattttggattgacgaaattgaaagtttttactgtgacttgtcaacttgcggctttaagttcgacttacagaaaaacgagtctcattacagctgtgaggaagtgaaatgtaaatgtgttcctggtgaaatgctatgtggcaagcagggctcgatcgatatttcagactttttgacagaaacaattaggggccctggtgatttcagttgtgatttgaataacaggaaatgtaaatttagtgaacccagtatgaacgacctgattttgactatattcggcgatccttatatcacgttgacatgccaatctggtgaatgtattcattacagtgagatacctggacatatatccccgccaaagaaaggaatgacggctttctcaacaatggtactggtattaacttcagctggtgtcatttttctcgcaacagtatcggtaatttatatttccagaagtccactttttaacaacagcccagttcaactatctgatagcgatgacgacgaaaatgaacctgatttcttgaagcctgatgtaaaagcaacattgaccttcgaaaatataaactatcaagttcgctcgtcaaagggttcgagtacccaagtgttgaacagtattagtggctcagtgaaacctggtgaaatattggccattatgggcggatctggtgctggaaaaacaactttattggatatccttgcaatgaaaaataagactggtaaggtcacaggctccatcagattgaatgggacagaagtgactaaacaaaattattcgaagattgttggttttgttgaccaagaagattttctcttgccaacgttaaccgtgtatgaaactgtgttgaatagtgctctactaagactgcctagatctatgagttttgctgctaagcagaaacgtgtctaccaagtcttggaagaactaaggatattcgagatcagaaatcgtgttattggtaatgacctcgagagaggtattagtggtggtgaaaaaagaagagtttctatcgcgtgtgagttggttacttcgccattaattttattcctcgatgaaccaacctcagggctggactccaacaacgccaacaacgtcattgaatgtctggttagacttgccaaccactacaatagaacattgattctttcaatccatcagcctagatcaaatatcttcaagctctttgataagctggtgttattaagtgaaggtgaattggtttattctggagaagcggttagagtgagcgaattcttgcgaaaccagggctttacatgtccctccgattacaatatcgcagactatctcattgacgtaactttcgagccaaagaaatacaccacccgctctgtggaagtcagtgatcttgaagctaatttgttaaactcacttggtgaaaatcgtacttctactggaattcatggtgttgatccagtaagaagttcgatagctagcatgacacaacgtgagtgggagcactacgctgtccacagagacgaatttagaggcctacttgtcactgacagtacaacagaggaaggagcagttggagccttaaacaataacttactccactcgatgtttagagaaagttcctacttctccgaactttcccaagatattgaaaatattaaagcatcctcaaactccgataatttgaaactaccggtttctcacgaggcagcctccttttcccagcaattggccattttgtgttcaagaaccttcaaaaacgtatacaggaaccctaagttgctgttaggaaactatgttctgacagttttattgggtttgtttcttggtattctatactacaatgtggaaaacgacataagtggatttcaaaataggctaggtctcttcttcttcatcctgacatactttggctttttgacatttacaggactaagctcttttgcgttagagaggataatttttttgaaagaacgttccaacaactactactcaccaatcgcgtatcatttgagcaaaatttggagtgatgtcataccattaagagtagtccctccaatcctgttgggcctcgttatttacccaatggttggattgaatatggatgacagcgcatttttcaaatttttgggtattttgattctgtttaatctggccatttcgatggagattctgaccattggtatcatatttgaagatttaaacaactcgattatcttgagtgtattgattctattgggctccctactattcagtggtttgtttattaatactaaggacattacgaatattgcattcaaatacttgaaaaacttttctgtgttctactacgcttacgagtccttgataatcaatgaggtgaagacgttaatcttaaaggaaaagaagtatggcttgaatattgaaattccaggtgcaaccatcttgagcacgttcggattcatagtccaaaacctcttctttgatgttaaaatgttactactgttcaatataatatttttggttttgggctacttggcgttgaaattgattgtggtggagcagaagtga

SEQ ID NO: 88 - protein, 1027 aa, Saccharomyces kluyveri
MRLVLSVLCISTLLGGFVQGESVIKDERFAVSIPPRHGNDNFGDEDKCPPCFNCMLPMFECKQFSKCNSYSGKCECLDGFGGEDCSQPLCGALSDGNSQRPIRGNETETCECKDGWGGINCNICKEDFVCDAFMPDDLKGTCYKNGMIVNKFHQGCDVTNKKIIQILNGRKPQVTFSCNKTAEVCDFQFWIDEIESFYCDLSTCGFKFDLQKNESHYSCEEVKCKCVPGEMLCGKQGSIDISDFLTETIRGPGDFSCDLNNRKCKFSEPSMNDLILTIFGDPYITLTCQSGECIHYSEIPGHISPPKKGMTAFSTMVLVLTSAGVIFLATVSVIYISRSPLFNNSPVQLSDSDDDENEPDFLKPDVKATLTFENINYQVRSSKGSSTQVLNSISGSVKPGEILAIMGGSGAGKTTLLDILAMKNKTGKVTGSIRLNGTEVTKQNYSKIVGFVDQEDFLLPTLTVYETVLNSALLRLPRSMSFAAKQKRVYQVLEELRIFEIRNRVIGNDLERGISGGEKRRVSIACELVTSPLILFLDEPTSGLDSNNANNVIECLVRLANHYNRTLILSIHQPRSNIFKLFDKLVLLSEGELVYSGEAVRVSEFLRNQGFTCPSDYNIADYLIDVTFEPKKYTTRSVEVSDLEANLLNSLGENRTSTGIHGVDPVRSSIASMTQREWEHYAVHRDEFRGLLVTDSTTEEGAVGALNNNLLHSMFRESSYFSELSQDIENIKASSNSDNLKLPVSHEAASFSQQLAILCSRTFKNVYRNPKLLLGNYVLTVLLGLFLGILYYNVENDISGFQNRLGLFFFILTYFGFLTFTGLSSFALERIIFLKERSNNYYSPIAYHLSKIWSDVIPLRVVPPILLGLVIYPMVGLNMDDSAFFKFLGILILFNLAISMEILTIGIIFEDLNNSIILSVLILLGSLLFSGLFINTKDITNIAFKYLKNFSVFYYAYESLIINEVKTLILKEKKYGLNIEIPGATILSTFGFIVQNLFFDVKMLLLFNIIFLVLGYLALKLIVVEQK

SEQ ID NO: 89 - DNA, 3036 bp, Ashbya gossypii
atggtgcgctgtgccacgctgttcacgtttctcaccgcatgcatttcgcttggtagcgcagtgcaggtggtacagcgaattcaggcgctaccccataggcggccaggtccaggcgacggcgacaaggaaaagtgtcccccatgctttaactgcatgctcccggggtttgaatgcaaacagtactccaagtgtaacccattcactggtcggtgcgattgccggccgggattcggcggggacgactgctcgcaaccgctatgtggggcgctgtcagaccgcaatgactaccggccagcaaggccgcagaatgaagtgtgcgagtgcgggcccggctggggaggtatcaactgcaacatgtgcgaggaggatgctgcatgcgacagcatggtgcctagtggcgttcggggaacgtgctatagaggagggatgattgtgcacagtttgcatcagggatgtaatataacgaatgagaaaattgtggagatgttgggtgacaagaaaccgcaggtgacgtttgcatgcaataaaactgcaggtgagtgtgacttccaattctggattgaccaggaggagagcttttactgtgggcttaacgaatgcaatttcaactatgatctgggcagcaattcgacccactatgagtgctctgagattcgctgcgagtgcataccgggaagaatgctctgtggacagaagggctccattgatatctcggagtttttgacagaggaaatcagagggcctggtgagttcagctgtaatgtggggactaaagaatgtcatttcagtgagccgagcatggatgagctgataggaacgatatttggagactcgtacataaaattgaggtgttcatcaggtgagtgtttgcattatagcgaagttcctggctacttacctccaccaaaacaaaaactgaatttctttggctatttggtgctttcagttacctctgcagtgctaatgggttcaatttctttggtggtcctctttatctcaagaagcccactgttctcgaacggccacattgagttgcctgaatatgactccatggaggaagacttcctcaagtccgggtcaatggccactttaacctttgagaatttgtgttataaggtgtttccttctaggtcatctcccgtccgcattctaaattctatcagtggatatgttagtcccggcgaaatacttgcagtcatgggtggatccggagcaggcaaaacctgtctcttagatattcttgggatgaaaaacaaggcaggtgaggtctctggtacagtgaagatcaatggcgtgccaattacgaagcatactgtgtccaaagttgtcggttttgtcgatcaggacaaccaccttctaccaacgcttaccgtgtacgagactgtactcaatagcgcattactgcgccttccaagatcgatgtcttttgctgcgaagcaaaagagggtataccaggtgctagaagaactcagaatttttgatattcgggaccgattgattggcaatgatttcgagaggggaattagcggtggtgagaagagacgggtctccatagcctgcgagctcgtgacttcaccgctgattctattccttgatgaaccaacatctgggctggactcgaataatgcaaataatgtcattgaatgccttgtgagactggcttctcaatatcgcagaacacttgttttgtctattcaccaacccaggtcgaacatttttagacttttcgataacttagtattgttgaatgaaggcgaaatggtatactccggtcctatcaccagggtgaatgacttcttacgcaacaccggtttcaattgcccttctgactacaatattgcggactatttgatagatattaatttcatgtctcctaccgccccctcattagagaatcctgacagtgcagacgtcgaagcagaggctggcaagagcgtcgaaaactctctgcatgttcctgagctgggtagatcatccacacagcgggaatgggagcactttgcccttcatcgcgacgagttgcgcagtatgctccaaaccggtgaggctgctggtgccgccggacatatgtcctcgcacaacctatcacgccttttcaaagagggctcccattttggtgaacttctttctcacatcgaggatgtcaataaagagtgccattccaataagctgactctgccctcctcctaccagggtgcgtcgttcctgcaacagctatccatcttgaactcgcgttctttcaaaaacatataccggaatcctaagctcctgataggcaactacgtgctcacagttatccttggccttttcttgggcgccctctactatggaatcgagaacgacatcagtgggtttcagaacaggcttggcctctttttctttgtcctgacatacttcggtttcctcaccttcaccggactgtcctcatttgcccaggagcgcatcatatttgtcaaggagcgttccaacaactactactcgcctgtggcattctatgtgagcaaggtgctgagtgacatcctgccgctcagggtcgttcctccgatcctactctgcctggtaatctacccgctcgtgggcttgaacatgtccaatggcgcctttttgaactgcattggcattttagtacttttcaacctgagcatatctatggagatcctggctgttggcctctttttcgaggacttgaacaactcgattgttttcagtgtgctgattctccttggctccttgctcttctgcggacttttcgtcaatacccagcgcattacgaactttgcgttcagatacatgaagaacctgtctgtcttctactatgcctacgaagcgctgatcattaacgaggtcaagagtttgacacttagggacaagaagtacggcctgaacatagagatacccggcgccaccattctcagcagcttcgggttttctgtgcagcatctgcagctggacatcgagatgctgggcgcgtgttgcgctgtattcctgctcgcagggtacttagtcttacagctactagtcatagagcataagtag

SEQ ID NO: 90 - protein, 1011 aa, Ashbya gossypii
MVRCATLFTFLTACISLGSAVQVVQRIQALPHRRPGPGDGDKEKCPPCFNCMLPGFECKQYSKCNPFTGRCDCRPGFGGDDCSQPLCGALSDRNDYRPARPQNEVCECGPGWGGINCNMCEEDAACDSMVPSGVRGTCYRGGMIVHSLHQGCNITNEKIVEMLGDKKPQVTFACNKTAGECDFQFWIDQEESFYCGLNECNFNYDLGSNSTHYECSEIRCECIPGRMLCGQKGSIDISEFLTEEIRGPGEFSCNVGTKECHFSEPSMDELIGTIFGDSYIKLRCSSGECLHYSEVPGYLPPPKQKLNFFGYLVLSVTSAVLMGSISLVVLFISRSPLFSNGHIELPEYDSMEEDFLKSGSMATLTFENLCYKVFPSRSSPVRILNSISGYVSPGEILAVMGGSGAGKTCLLDILGMKNKAGEVSGTVKINGVPITKHTVSKVVGFVDQDNHLLPTLTVYETVLNSALLRLPRSMSFAAKQKRVYQVLEELRIFDIRDRLIGNDFERGISGGEKRRVSIACELVTSPLILFLDEPTSGLDSNNANNVIECLVRLASQYRRTLVLSIHQPRSNIFRLFDNLVLLNEGEMVYSGPITRVNDFLRNTGFNCPSDYNIADYLIDINFMSPTAPSLENPDSADVEAEAGKSVENSLHVPELGRSSTQREWEHFALHRDELRSMLQTGEAAGAAGHMSSHNLSRLFKEGSHFGELLSHIEDVNKECHSNKLTLPSSYQGASFLQQLSILNSRSFKNIYRNPKLLIGNYVLTVILGLFLGALYYGIENDISGFQNRLGLFFFVLTYFGFLTFTGLSSFAQERIIFVKERSNNYYSPVAFYVSKVLSDILPLRVVPPILLCLVIYPLVGLNMSNGAFLNCIGILVLFNLSISMEILAVGLFFEDLNNSIVFSVLILLGSLLFCGLFVNTQRITNFAFRYMKNLSVFYYAYEALIINEVKSLTLRDKKYGLNIEIPGATILSSFGFSVQHLQLDIEMLGACCAVFLLAGYLVLQLLVIEHK

SEQ ID NO: 91 - DNA, 3069 bp, Kluyveromyces lactis
atggttgcatacagatatttaccgagtctgttcagtttcttatggttggtggcatatgtcagtagtgaaataattggccaagagaccagtttccggccaggaaccttgccagaaagaggaggaaaaaaacctaataatgatcaatgcccaccttgtttcaattgtatgcttcctatgtttgaatgtaaacagttttcagagtgcaattcgtataatgggaggtgtgaatgtcttgaagggttcggcggtgatgactgttctgtgccactatgtggtgcattgagcgacgataactccaagaggccgatgagaagcaacgaaactaacacgtgtgagtgtagtccaggttggggctctatcaattgtaacgtctgtcaagaagattctgtttgtgatgccttcatgcccagtggtttgaaggggacatgttataagaatggtatgattgtcaaccaattccatcaaggatgcaatgttacaaatacgaagattgtggagatcttgaagggggcaattcctcaggttactttctcatgcaataagacttctgagttatgcaattttcaattttggattgatcaagtcgagagcttttactgcgggttagatacatgtgcatttgagtatgatttgcaaaagaatgtgtcacactataaatgtgagaacgttaagtgtaaatgtgttcctggcgaaatgctttgtggtagaaaggggtctattgatatttccgatttcttgactgaaacaattaagggtcctggtgactttagttgtgatttggaaacaaaaaaatgtaaattttcggaacctagcatgaatgatttaatcctaactgtatttggagatccttacattacgttgaaatgtgaatctggtgaatgtgttcattacagtgagattccgggctacaaaattccagataaagaccgtttgtcaacgtcatccattctagttcttgttttgagttctgtggggatatttgctgtcgcgtctattgccatctacttcatttctaaaagccctatattttccaatggcccaattaagctatctgatggtgacgatgaggatgattttgaccttttcaaaacaaattcaagtgcaactttgacttttgaaaatatcacttatgaggtgtctcctgctaagaatgtgactgctgacgtattgaatgaagtcacaggatctgttaaacctggtgagatgttagccattatgggcggttcaggcgctggtaaaactactttgcttgatatccttgccatgaagaacaaaactggtaaagttaccggctcaataaaggttaacggtgtagatatcgataaggataaatattctaagattatcggatttgtcgaccaagaggactacttgttaccgacgttgacagtttatgaaactgtattgaacagtgctttattgcgtttgcctagacaactaagcttcagtgctaaacaaagacgagtatacgatgttttggaagaattaaggattttcgacattagagatagagtaattggaagtgaatatgaaagaggcatcagtggtggtgaaaagagaagagtttccattgcttgcgaattggttacttctcctcaggttcttttccttgatgagccaacttcagggttagacgctaacaatgctaacaatgttatagaatgcttggttagactagctaatcattataacaaaacgttggttctttccatccatcaaccaagatccagcattttccaactgtttgataaattggttcttttaagcaacggtaaaatggtttattctggagatgctcataaagtcaatgaattcttgaaaaatgagggttatgcctgtccaccggattacaacattgctgattatctaattgatgtgacttttgaaccatctaaatttgttacgagggcaaatatcgatgaccttgaggctacactacctactacagagggtcttaacccagttcacagggttgagccgcatcgccgttctttgactggaagcccaacacagacagagtgggaacatctggctcttcacagggacgaatttagggatttgttatctcagtccgaaaacgagggccaaactgtgggtgatgtcaacacgcacctattacattctcttttcaaagatggtgcatatttccagaaactgaagtttgaaattaatgaaattttgtctgccggtataaacgaagaattaagaattccacaagcatacaaagcggcaactttcttgcagcaactctcaattttgagttcaagaacgttcaaaaatgtctgcaggaatccaaagctattgttaggtaactacgtcttgacggtagctttgggtttattcctgggtatcctatactataatgttgaaaacgatatcagtggattccaaaacagactaggccttttcttctttattttaacgtatttcggtttcctgacattcactgggttaagctccttctctttggaaagattgatttttatcaaggaacgttccaatcattactattctccgctagcgtattacatttcaaaaatactatctgatattattccattacgtgtggtaccacctatcctacttgggttaatactttatcctttggttggtttaaatatgaatgataatgggttcttcaaatttgaaggtattctaatcttattcaaccttgccatctcactggagattttgacagttggtatcatttttgaagacttgaataactcgattataatcagtgttttgataatccttggttctttgttattcagtggattattcatcaacactaaggatattaacaatattctgttcaaatatttgaagaacctttcagtgttctattacgcctacgaatctttgattatcaatgaagtcaagtctttggttcttagagagaagaagtatggtctcaatattgaaatcccaggtgccactatcctaagcacattcggtttcatcgtacaaaacctagtgttcgatgtcaaaatactagcgctattcaatgtcatattcctaatattcggctatttcgctcttaagttgatagttattgagcaaaagtga

SEQ ID NO: 92 - protein, 1022 aa, Kluyveromyces lactis
MVAYRYLPSLFSFLWLVAYVSSEIIGQETSFRPGTLPERGGKKPNNDQCPPCFNCMLPMFECKQFSECNSYNGRCECLEGFGGDDCSVPLCGALSDDNSKRPMRSNETNTCECSPGWGSINCNVCQEDSVCDAFMPSGLKGTCYKNGMIVNQFHQGCNVTNTKIVEILKGAIPQVTFSCNKTSELCNFQFWIDQVESFYCGLDTCAFEYDLQKNVSHYKCENVKCKCVPGEMLCGRKGSIDISDFLTETIKGPGDFSCDLETKKCKFSEPSMNDLILTVFGDPYITLKCESGECVHYSEIPGYKIPDKDRLSTSSILVLVLSSVGIFAVASIAIYFISKSPIFSNGPIKLSDGDDEDDFDLFKTNSSATLTFENITYEVSPAKNVTADVLNEVTGSVKPGEMLAIMGGSGAGKTTLLDILAMKNKTGKVTGSIKVNGVDIDKDKYSKIIGFVDQEDYLLPTLTVYETVLNSALLRLPRQLSFSAKQRRVYDVLEELRIFDIRDRVIGSEYERGISGGEKRRVSIACELVTSPQVLFLDEPTSGLDANNANNVIECLVRLANHYNKTLVLSIHQPRSSIFQLFDKLVLLSNGKMVYSGDAHKVNEFLKNEGYACPPDYNIADYLIDVTFEPSKFVTRANIDDLEATLPTTEGLNPVHRVEPHRRSLTGSPTQTEWEHLALHRDEFRDLLSQSENEGQTVGDVNTHLLHSLFKDGAYFQKLKFEINEILSAGINEELRIPQAYKAATFLQQLSILSSRTFKNVCRNPKLLLGNYVLTVALGLFLGILYYNVENDISGFQNRLGLFFFILTYFGFLTFTGLSSFSLERLIFIKERSNHYYSPLAYYISKILSDIIPLRVVPPILLGLILYPLVGLNMNDNGFFKFEGILILFNLAISLEILTVGIIFEDLNNSIIISVLIILGSLLFSGLFINTKDINNILFKYLKNLSVFYYAYESLIINEVKSLVLREKKYGLNIEIPGATILSTFGFIVQNLVFDVKILALFNVIFLIFGYFALKLIVIEQK

SEQ ID NO: 93 - DNA, 3060 bp, Kluyveromyces waltii
atgcacctgaatgttgccttgggatgcctttcggccttgttacttaactctgcggcgcaagatattccccaaacgaatttgatttaccagggtacgccattaagtaccccaagaaaaatgattgcagaagaccagtgtcctccatgtttcaattgcatgctacctatcttcaaatgtaaacaattttctaagtgtaactcaaatactggaagatgcgagtgcctcgccgggttcggcggcgacgattgctcaatccctttatgcggatccctttctgaagaaaatgataagcgtccgctccgggataacaaaaccgaaagctgtaattgtgaggagggttggagcggcattaattgtaatatatgtgaagaggactcggtgtgcgaccctttcatgcccgagggtctgaagggaacatgttacaagaacggaatgattgtaaatcaatttcatcaggggtgcgatgtgacaaacgaaaaaatagtgcaaattttgaagggcaagaaacctcaagttaccttctcttgcgataagaagtctgagaaatgcaattttcaattttggattcaagaagttgaaagcttctattgtgggttatcaagttgccaatttcaacaagatctgagtagtaatacttctcattacaaatgtgagagcgttcaatgtgaatgtattcttggcgagatgctttgcggacaaaaaggctcaatagacatctctgagttcctcactgagactataaaagggcctggagattttagttgcaacttagagacgaaaaaatgtgttttcagtgaaccaagcatgaatgatttgatcagtaccgtctttggggaccctcacatcacccttcagtgtcaatcaggggagtgcgtacactacagtgaaataccaggatatcaagagccgtctaaagataaattgtctattttccatatcattgccctttctgcgacgtccacaattgttgttgttctcaccatcctctcgcttgttttcattacgaaaagccctctttttaaaggaactccagttcaattagacgaagacgaggacgacgacttcgattttttgaaaacgagcttcaaatctactttaacctttgaaaatatcgagtacaatatacgttcagagaagggagagaggatgatcctgaatggaataagcgggtctgttaaaccaggagaaattatggctttaatgggcggatctggtgctggtaagactaccctattagacatcctggcaatgaaagataaggctgggaaggcctctgggtccattaaaattaacggctcggaaatcacgaaacaaaatttaagcaagattgctggatttgtcgatcaggagaattttttactgcctactttgaccgtatatgagacagttttgaacagcgccttgctgcgtttaccaaggaagctatcatttgttcaaaagcagaagcgtgtatatcaggtcctcgaagagcttcggatacttgacatcaaggatcgcatcattggagatgatcttgaaagaggaattagtggtggagagaagaggagagtttccatcgcttgcgaacttgttacttctccttcagtcttgttcctggatgagccgacttccggtcttgattccaataatgccaacaacgtcattgagtgcttagtgcgcctcgctttgcattacaatcgtactttgattttatcaattcatcagccacgttcaaatatcttcaagtcatttgacaagttagtgcttttgagtcaaggcgaaatggtgttctcaggcgttgcaactgacgttagcgagtttcttcgaaacaacggctacaactgcccttcagattataacattgcagactacctcatcgatatcacatttgaaacacggaagcctttgacagccttgacctcgggcccagatgacctagaatccaacattcacagtaaccataatcatgagattggcttggatgagcctattgggcgcaaggactcgactgttgcaacgcagcgtgaatgggaacattacgcagtccatagggacgagttaagatcactacttgatcaagccgccgatacaggaaacgacattcagggcttcttgaatactcaggtgttacacgctaagttcagggaaggccaatacttttcgactctcatagaagacatcgaaaacacaaaagcgtcctctgttagtgggggagaagagatgcctatcagctcaatgtctgcctcgttcaaagaacaattaactatcctatcgtcaaggacattcaaaaacatctatcgcaaccctaagttattacttggaaattacgttgttacaatttttatgggatgctttttgggatcgctctactataatgtcgaaaacaatataagcggtttccagaatcgccttggcctgttttttttcatattgacctatttcggatttttgacatttacaggcctgacgtccttctctttagagagaatcatttttctgaaagagcgttcgaacaactattactcacccatggcttattatatcagtaaaatcctaagtgatgttctgcctttgagagtaatacctccgattctcttggcattggttgtataccctacagtgggtctcaatatgagcaatggagctttcttcaagttcgtggcgatattagtattgttcaatgttggtatttctctagaaattttgactgttggaattttggtggaagacctaaacaactcaattgtcatcagcgttcttattttactggcgtctctgttgttcagtggacttttcatcaacactaaagatatcagcaatgtcgccttcaaatatttgaagaacttgtcgattttctactacgcttacgagtctttgatcatcaatgaagtcaaatctctggtattgaaagaaagaaaatatggcctgaatattgaagttccgggtgctactatcctaagcacgttcggattcatcgtccagaactttttactcgatgtgaaattattggttgccttcaatgtgctcttcttggtgctaggatatctgggtcttgaactcattgtagttgaacagaagtaa

SEQ ID NO: 94 - protein, 1019 aa, Kluyveromyces waltii
MHLNVALGCLSALLLNSAAQDIPQTNLIYQGTPLSTPRKMIAEDQCPPCFNCMLPIFKCKQFSKCNSNTGRCECLAGFGGDDCSIPLCGSLSEENDKRPLRDNKTESCNCEEGWSGINCNICEEDSVCDPFMPEGLKGTCYKNGMIVNQFHQGCDVTNEKIVQILKGKKPQVTFSCDKKSEKCNFQFWIQEVESFYCGLSSCQFQQDLSSNTSHYKCESVQCECILGEMLCGQKGSIDISEFLTETIKGPGDFSCNLETKKCVFSEPSMNDLISTVFGDPHITLQCQSGECVHYSEIPGYQEPSKDKLSIFHIIALSATSTIVVVLTILSLVFITKSPLFKGTPVQLDEDEDDDFDFLKTSFKSTLTFENIEYNIRSEKGERMILNGISGSVKPGEIMALMGGSGAGKTTLLDILAMKDKAGKASGSIKINGSEITKQNLSKIAGFVDQENFLLPTLTVYETVLNSALLRLPRKLSFVQKQKRVYQVLEELRILDIKDRIIGDDLERGISGGEKRRVSIACELVTSPSVLFLDEPTSGLDSNNANNVIECLVRLALHYNRTLILSIHQPRSNIFKSFDKLVLLSQGEMVFSGVATDVSEFLRNNGYNCPSDYNIADYLIDITFETRKPLTALTSGPDDLESNIHSNHNHEIGLDEPIGRKDSTVATQREWEHYAVHRDELRSLLDQAADTGNDIQGFLNTQVLHAKFREGQYFSTLIEDIENTKASSVSGGEEMPISSMSASFKEQLTILSSRTFKNIYRNPKLLLGNYVVTIFMGCFLGSLYYNVENNISGFQNRLGLFFFILTYFGFLTFTGLTSFSLERIIFLKERSNNYYSPMAYYISKILSDVLPLRVIPPILLALVVYPTVGLNMSNGAFFKFVAILVLFNVGISLEILTVGILVEDLNNSIVISVLILLASLLFSGLFINTKDISNVAFKYLKNLSIFYYAYESLIINEVKSLVLKERKYGLNIEVPGATILSTFGFIVQNFLLDVKLLVAFNVLFLVLGYLGLELIVVEQK

SEQ ID NO: 95 - DNA, 3168 bp, Candida glabrata
atggccaaatggccatcttatagcgggaaccagatatacgtgccggacacctcagtgccagatacttcagtgccggactcatgtccgccttgcttcaactgtatgctgccgatgtttgcgtgcagccagttctcggagtgtgactcgtacacgggccagtgtgagtgtatccccgggttcggcgggctcaattgctccgatgccctgtgcggggcgctggacttgcctaacagagataggccacccagggcccagaacttgacctacggcagggacaactcctgcgcgtgtgcggacggctggggtggcatcaactgtaacctgtgtcagagagacgacgtgtgcgactcgttcatgccggactcgtccttgaaaggtacgtgctaccgcggaggtgccctcgtgcacaaggtattccaaggctgcgatgtgaccaacgagaagatactgcaggtgctgcatgggcagaagccgcaggtcaccttcagttgcgacagggcaaaagaggagtgcaacttccagttctgggtcgaccagattgagagtttctactgtggcctcgacaactgtactttcgaacacaacataaacgacaacaccacccactacaagtgtgccaacgcacagtgtaagtgcgtcccagggactttgctgtgcgggctcaagggctccattgacatctcggagttcttgaccgaaaccatcacgggacccgcagatttcgcttgtgaaagagaccaggcctccgacaagattgtacagaactgtaagttcagcgagccttcgatgaacgacttgatatcaactgtgttcggcgaccgctacatcactttgtcgtgtaactcaggggaatgtgtacaccacagcgaaattcctgggtataagataccttccaggagtcccgatatgaccctcaagggaagactcatgctggctttcacttcgctggttgtcctggtaggtgtaagctttgtcgcgtggtatgtgtctcaatcaccgttattcaaagcaggtagtattcaattgctaaatgctgactcattactggtcaatggatcggcagatgaaactgagaatttcttgcagtctagtaaatccgcaacgcttaccttcgaaaacatcaattattatgtcgcagcatctgccaactccagatctgatgaaaagcaaagagtgctgaatgatatatccggactggttaaaccaggtgagatattatccattatgggtggatcaggtgctggtaagaccacgttgctagatatcctagcaatgaaaaggaaaaccggtgatgtcagtggctccataagagtcaatggtaaggtagtgtcgagaaaggactatacaaagctcattggttttgtagaccaagatgactatctgttgccaactttaaccgtttacgagactgttttaaatagcgccctgttgagacttccaaggacaatgtcctttgaagcaaaacaggctcgtgttttccacgtattggaagaactaaggataatggatataaaagatcgtattgttggtaatgactttgaaaggggtatcagtggtggtgaaaaaagacgtgtatctattgcgtgtgaactggttacatccccattagtgctgtttttggatgaacctacctctggcctcgatgcaaacaacgctaacaatgttattgagtgtcttgtaagactggcaagaaattatgatagaacattagttatgtcaatacatcagccaagatctaacatattctacaggttcgataagctggtcttattgagtcgtggtgaattggtttattctggagaggctttaagagttaatgagtttttgaaaaacaatggttaccaatgtccatcaaattacaatattgcagattaccttattgatataacttttgagtctggagacaagaagaaaaagaaatcaaaagctagtcatattctaagcgaaatattacctgacttagaagttggaacaccagcgaacgaagatggtcatgatcatgcagcagaaatactcggtggaggagacgatagaagtggatcgattagtactgctacccagagggaatgggagcactatgcaactcacagagaagaaatcagtaccttactgcgtcatgaaactgaagaaaatctagaaaatgaaatacaaagtgcgggggacttaaacaccataatattgtcaaagaaatttaaggatggccaatattatggagaattaaagtttaatattgaggagattaagagagaagcaaacccaactggagaaacaaacactacatccgaaaccagtagcacatctttcgagattcctactactttgaaggcagcttccttttctgagcagctgtccattctttgttcaaggtcattcaagaatatatatagaaaccctaaacttttgctcggtaattacttactcactgttttgctaggtgttttcttaggagtattatactataaggttgaaaatgatatcagtggttttcagaaccgtatgggtttgttcttctttattctgacatattttggctttgtaacttttacaggcttaagttcgtttgctttggagagaattattttccttaaggagagatcgaataactattattccccattggcatattacggcagcaaaatacttgttgacgttattccattgagagtgattcctccaatcctgttgtgtatgatcgtttacccactagtaggtttgaatatgagagatgatgcatttttcaaatgtattggtattctggttcttttcaaccttgctatttcgatggagattttgacaattggtataatatttgaagacctaaataactcgattgtcataagtgtcttggttttactagcctcattacttttcagcggtttgtttattaacacaaaagatattacaaacatggctttcaagtatctcaaaaacttttcagtgttctattatgcatacgaagctctgttgataaatgaggtaaaaaccttgatgttgagagaaagaaagtatggattaaatattgaggtgcccggagccattattttaagcacatttggattccaagtacaaaatcttgtatttgacataaaaactctggcattgttcaacgccattttcttggtgttgggctacttagcattgaaattaatagtagtagaacaaaaatag

SEQ ID NO: 96 - protein, 1055 aa, Candida glabrata
MAKWPSYSGNQIYVPDTSVPDTSVPDSCPPCFNCMLPMFACSQFSECDSYTGQCECIPGFGGLNCSDALCGALDLPNRDRPPRAQNLTYGRDNSCACADGWGGINCNLCQRDDVCDSFMPDSSLKGTCYRGGALVHKVFQGCDVTNEKILQVLHGQKPQVTFSCDRAKEECNFQFWVDQIESFYCGLDNCTFEHNINDNTTHYKCANAQCKCVPGTLLCGLKGSIDISEFLTETITGPADFACERDQASDKIVQNCKFSEPSMNDLISTVFGDRYITLSCNSGECVHHSEIPGYKIPSRSPDMTLKGRLMLAFTSLVVLVGVSFVAWYVSQSPLFKAGSIQLLNADSLLVNGSADETENFLQSSKSATLTFENINYYVAASANSRSDEKQRVLNDISGLVKPGEILSIMGGSGAGKTTLLDILAMKRKTGDVSGSIRVNGKVVSRKDYTKLIGFVDQDDYLLPTLTVYETVLNSALLRLPRTMSFEAKQARVFHVLEELRIMDIKDRIVGNDFERGISGGEKRRVSIACELVTSPLVLFLDEPTSGLDANNANNVIECLVRLARNYDRTLVMSIHQPRSNIFYRFDKLVLLSRGELVYSGEALRVNEFLKNNGYQCPSNYNIADYLIDITFESGDKKKKKSKASHILSEILPDLEVGTPANEDGHDHAAEILGGGDDRSGSISTATQREWEHYATHREEISTLLRHETEENLENEIQSAGDLNTIILSKKFKDGQYYGELKFNIEEIKREANPTGETNTTSETSSTSFEIPTTLKAASFSEQLSILCSRSFKNIYRNPKLLLGNYLLTVLLGVFLGVLYYKVENDISGFQNRMGLFFFILTYFGFVTFTGLSSFALERIIFLKERSNNYYSPLAYYGSKILVDVIPLRVIPPILLCMIVYPLVGLNMRDDAFFKCIGILVLFNLAISMEILTIGIIFEDLNNSIVISVLVLLASLLFSGLFINTKDITNMAFKYLKNFSVFYYAYEALLINEVKTLMLRERKYGLNIEVPGAIILSTFGFQVQNLVFDIKTLALFNAIFLVLGYLALKLIVVEQK

SEQ ID NO: 97 - DNA, 3144 bp, Kluyveromyces polyspora
atggtgatgaaaccatttccgttttataatggtttgcatttattatctttaattattattattaccaaaattgtgttagttcaatcgtcttcccaggaaacctttgactataagaataatgatttgttgaattttaatgttaataagaacaataacgaaacatgccctccatgttttaattgtatgctaccaatctttgaatgtaaacaatattcaaattgtaattcatatactggtcaatgtgactgtatagatgggtttggtggtgatgactgtgctctaccactatgtggttcattacaaccaccaattgacaatgacaagggtaattctgctaataatctcaacagacctttgcgtaacgaaactttaggtaagtgcacttgtgatgatggttggggtggcattaactgtaacgtttgcgaacaagataacgtttgtgatatttttatgcctgataaatccattaaaggtacttgtaataaaaatggtatcattgttaaaaaaatcaaccaatattgtgacgttactaatgaaaagattttatcaattttgaaaggatcaattccacaggttacatttgcttgtaataaattggataaaaattgtaatttccaattttgggttgatcaaattgaaagtttctactgtggtttagataattgtacttttaattatgatttggaaaaaaatactacacattacgaatgtgaagatattaagtgtaaatgtattccaggtaccttcctttgtggtaaaaatggatcaattgatatttcggaatttttatctgaaactattagaggtcctggtgattttgcctgtgaattgggtgaaaataattgtaaattttctgaacctgctatgaatgacttgatcctaactgtttttggtgacccttatatcacgcttaaatgtgattcaggtgaatgtatgcattattcagaaattccaggttacgttttacctcctgaccgctcaagatttggttggagatccaacatagttttaggtattacctttttggtcttggtaactttggttggaatttctgttctaaatattagcaaaaattcacctttatttcaaaatagttcaattagattaccaatttcaggtgatgatactggaaatggagtttcacaagaaagtttcctaaaaactgattcatctgcaactctatcctttgaaaatgtctcctattacattaataacgaagaaaacgaattcgaaccaagaaagattatacacaaagtttcagggttagtaaaacctggtgaaatattggctatcatgggtggttcaggtgcaggtaagacaactctattagatattctagcaaagaaaagaaaaactggtagagtttcaggtacattgaaaatcaatggtattgatataccaagaaataaatacacaaaattaattggtttcgtagatcaagatgattatcttttgccaactctaactgtctatgagactgtgctaaatagtgcattattacgtttaccaagatcaatgtcatttgctgctaaaagagctcgtgttttccaagttttagatgaattgaggattttagatattaaagatagaattattggtaatgattatgaaaggggaattagtggcggtgaaaaaaggcgtgtttccatcgcttgtgaattagttacttctccactgattttgtttttggatgaaccaacctctggtttggattccaataatgcaaataatgtagttgaatgtcttttgaggttgagcaaagattataagagaactttaatcttttctatacatcagcctagatcgaacattttccacttatttgataaattggtcttattaagtaatggtgatatgatttattctggcgacgctataaaagttaatgatttcttaagaaacagcggctatgaatgtccagaaggttataatattgctgattatctgatagatataacatttgacttggccccaaatttaaagaccaataacgctaaatctcggatccatgacgcagaaaatattttattacagggaaatgactcagcacaaaagaatatgacgagatctgtaacccagggtgaatgggaacattttgcgacacatagagatgagatgagaaacttacttcaagagagctcggcgccagagaatgaaactgttaattcaatgaattctaagttattatgcaaaaagttcagggatgggcagttctttgatcagctagtctctgaaattgatcaaagtgatactgaagcgtcaacaaattctacatcattggcagttccttcggttaagaaggcagcatcattcggtcaacaattgtctattttatgttccagatcctttaagaatgtgtatagagatccaaagttattattggaaaattatggtttaaccgttcttttggcgttgttcttgggggcattgtactataacattacaaatgatattagtggtttccaaaatcgtatgggtttattcttttttattttaacgtactttgggttcattacttttacaggtttaagttcattttcttttgaaagaataatatttatcaaggaaagatcgaataattattactctcctttagcatattatttaagtaaaattattagtgacttgatacctttaagagttattcctccagttttgttagcacttgttatttatccaatggcgggtttaaatttgagggaaagtggttttctcaaattcattattattttgattctatttaacttcgggatatcattagagatattaacaattggtattacatttaaagatttgaataattcgataatattaagtgtgttggtattgcttggctccttattatttagtggtcttttcattaatacccaagatattaccaatgttgcattcaaatatttaaagaatatttcgattttctactatgcatatgaggctctactgatcaatgaagtaaaaactctgattcttcgtgaaaaaaaatatggacttaacattgaagtaccgggagcaactatattaagtacatttggtttcaaggttcaaaacttatttttcgatattaagatattagccttgtttaatgtagtatttttgattttgggttatttatcattgaaacatttagtagttgagcaaaagtaa

SEQ ID NO: 98 - protein, 1047 aa, Kluyveromyces polyspora
MVMKPFPFYNGLHLLSLIIIITKIVLVQSSSQETFDYKNNDLLNFNVNKNNNETCPPCFNCMLPIFECKQYSNCNSYTGQCDCIDGFGGDDCALPLCGSLQPPIDNDKGNSANNLNRPLRNETLGKCTCDDGWGGINCNVCEQDNVCDIFMPDKSIKGTCNKNGIIVKKINQYCDVTNEKILSILKGSIPQVTFACNKLDKNCNFQFWVDQIESFYCGLDNCTFNYDLEKNTTHYECEDIKCKCIPGTFLCGKNGSIDISEFLSETIRGPGDFACELGENNCKFSEPAMNDLILTVFGDPYITLKCDSGECMHYSEIPGYVLPPDRSRFGWRSNIVLGITFLVLVTLVGISVLNISKNSPLFQNSSIRLPISGDDTGNGVSQESFLKTDSSATLSFENVSYYINNEENEFEPRKIIHKVSGLVKPGEILAIMGGSGAGKTTLLDILAKKRKTGRVSGTLKINGIDIPRNKYTKLIGFVDQDDYLLPTLTVYETVLNSALLRLPRSMSFAAKRARVFQVLDELRILDIKDRIIGNDYERGISGGEKRRVSIACELVTSPLILFLDEPTSGLDSNNANNVVECLLRLSKDYKRTLIFSIHQPRSNIFHLFDKLVLLSNGDMIYSGDAIKVNDFLRNSGYECPEGYNIADYLIDITFDLAPNLKTNNAKSRIHDAENILLQGNDSAQKNMTRSVTQGEWEHFATHRDEMRNLLQESSAPENETVNSMNSKLLCKKFRDGQFFDQLVSEIDQSDTEASTNSTSLAVPSVKKAASFGQQLSILCSRSFKNVYRDPKLLLENYGLTVLLALFLGALYYNITNDISGFQNRMGLFFFILTYFGFITFTGLSSFSFERIIFIKERSNNYYSPLAYYLSKIISDLIPLRVIPPVLLALVIYPMAGLNLRESGFLKFIIILILFNFGISLEILTIGITFKDLNNSIILSVLVLLGSLLFSGLFINTQDITNVAFKYLKNISIFYYAYEALLINEVKTLILREKKYGLNIEVPGATILSTFGFKVQNLFFDIKILALFNVVFLILGYLSLKHLVVEQK

SEQ ID NO: 99 - DNA, 3162 bp, Saccharomyces bayanus
atgaaaagttatcgacattatatctattataccgtgatatcgttcctgttattgtgctgctccgtttcactcgcaaaacaggaagagactccgttcttcaaagacactgtacctgaaggatcgcacctgtctacatcagataacggcaatgatacgtgcccgccatgtttcaactgtatgctgccaattttccagtgtaaacagttctctgaatgtgactcatacactggccgatgtgaatgtatagaagggtttgcaggcgatgattgttctctgcccttgtgtggcggtctctcaccggatgaaagcggtaataaggatcgtcctgtaagagcgcagaatgacacctgtcattgtgacgatggatggggtggaattaattgtgacgtttgccaagacgattttgtttgtgatgcattcatgcccgattccagtatcaagggtacttgttataagaacggtatgatcataaacaaagtcttttcaggatgtgatgtgaccaatgaaaaaatcctacagattttaaacggtaaaataccacaaattacatttgcttgtgataaacccaatcaggaatgtaactttcagttttggatagaccaattagaaagtttttactgtgggttgaatgattgtgcttttgagtacgacttggaccacaatacctctcattataaatgtagtgaagttcaatgtaaatgtattcccgacacaatgctgtgtggtgctaaagggtctattgatatctccgagtttctaacggaaactataagaggcccgggggacttcagttgtgatttggaaacaaggcagtgtaaattcagcgagccatccatgaatgatttgatcttgactatttttggtgatccttacatcactctgaaatgtgaatctggtgaatgtgttcattacagtgagattccgggttataaatctccttctaaggacccagcggtgtcatggcagggaagattggtactggctttgactgctgtgatggtattggtactcttcacgtttgccaccttttacatctctaaatcaccattatttaagaatggggcgggatcttcgaagtcccctattcgtttgccagacgaagatgcaatgaataatttcttgcaaaatgaagatgatacattggcaacattaagttttgaaaacatcacgtacagtgtaccctcgataaattccaacggcgttgaagaaaccgtactgaatgaaatcagtggtatcgttaggccaggtcaaattttggctattatgggtgggtccggcgcgggtaaaacaacgttgttagatattctagcaatgaaaagaaagacgggccatgtttctggtagcatcaaggttaatggtactagtatgaaccgtaaagccttctctaagataaccggattcgtggatcaagacgatttcttattacctacactaactgtctacgaaactgtcctgaatagtgcattattgagattgcccaaagtgctatcctttgaggccaagaaggcgcgtgtttataaagtgttggaagaactaagaatcattgatatcaaagaccgtattatcggcaatgaatttgaccgtggtatcagtggaggtgagaaacgtcgtgtttctattgcgtgtgaactggtgacgtctccattggtattatttttggatgaacctacgtctgggttagatgctagtaacgctaataatgttatcgaatgcctagtgagactatctagtgattataatagaactttggtgttatccattcatcagccaagatcgaacatattctatttatttgacaaattggttttattaagtaaaggtgaaatggtatactcaggaaactctaagaaagtctcagaatttttgagaaacgaagggtacgcttgtcccgataattacaacatcgcggattatctgatcgatattacttttgaaaccaccccgcaggggaagagaagaagaatacgaaatatctcggatttagaagccggcacgaatgctaacggtgacgataatgataatgataatgataatatcattcatcaaccagtattaactaccagtgacggtaccacacagagagaatgggctcatctcgcggcccatagagatgaaatcagaacattgttgagagaggatgaggagggaaccgacggaacacgaggcaccaccgagatcgatttgaacaccaagatattacacgataaatacaaagatagtgtttattttgccgagctttcacaagagattgaagatgttatgaatgaagccgatgaaaacagcaacgttttgaacggagatttgcccacgggtcaagaatctgccggtttcttacaacagttatcgatattaaattcaaggagtttcaaaaatatgtataggaatcctaagctcttattggggaactacgtcttgacgattctactaagtctgttcttggggacgttatactacaacgtctctaacgatatcagtggtttccagaatagaatggggttgttcttctttatattgacctactttggatttgtcacatttacgggcctgagctcgtttgccctggagaggattattttcatcaaggaaagatctaataattactattcgccatttgcatactacattagtaagataataagtgaagtggtgccactacgagtggtgccacccatactattatcgttaatcgtgtatccgatgacgggtctcaacatgaaagacaacgcctttttcaagtgtatcgggatacttatattgttcaacttgggtatatcactggagatcttgaccatcggaataatcttcgaggacttgaacaattccatcatactaagtgtattggtgctcttgggctcactacttttcagcggattatttatcaacaccagtaatattaccaatgtggcgttcaagtacttgaaaaacttctccgtgttctactacgcctacgaatccctactgatcaacgaagtcaagacattgatgttaaaggagaggaagtacggcttgaacatcgaagttcccggcgccactatcctaaccactttcggatttgtcgtccaaaacctggtctttgacatcaagatcctggctttgtttaatgtcgtgtttctaataacggggtatttggcccttaaatggatagtcgtggaacaaaaatag

SEQ ID NO: 100 - protein, 1053 aa, Saccharomyces bayanus
MKSYRHYIYYTVISFLLLCCSVSLAKQEETPFFKDTVPEGSHLSTSDNGNDTCPPCFNCMLPIFQCKQFSECDSYTGRCECIEGFAGDDCSLPLCGGLSPDESGNKDRPVRAQNDTCHCDDGWGGINCDVCQDDFVCDAFMPDSSIKGTCYKNGMIINKVFSGCDVTNEKILQILNGKIPQITFACDKPNQECNFQFWIDQLESFYCGLNDCAFEYDLDHNTSHYKCSEVQCKCIPDTMLCGAKGSIDISEFLTETIRGPGDFSCDLETRQCKFSEPSMNDLILTIFGDPYITLKCESGECVHYSEIPGYKSPSKDPAVSWQGRLVLALTAVMVLVLFTFATFYISKSPLFKNGAGSSKSPIRLPDEDAMNNFLQNEDDTLATLSFENITYSVPSINSNGVEETVLNEISGIVRPGQILAIMGGSGAGKTTLLDILAMKRKTGHVSGSIKVNGTSMNRKAFSKITGFVDQDDFLLPTLTVYETVLNSALLRLPKVLSFEAKKARVYKVLEELRIIDIKDRIIGNEFDRGISGGEKRRVSIACELVTSPLVLFLDEPTSGLDASNANNVIECLVRLSSDYNRTLVLSIHQPRSNIFYLFDKLVLLSKGEMVYSGNSKKVSEFLRNEGYACPDNYNIADYLIDITFETTPQGKRRRIRNISDLEAGTNANGDDNDNDNDNIIHQPVLTTSDGTTQREWAHLAAHRDEIRTLLREDEEGTDGTRGTTEIDLNTKILHDKYKDSVYFAELSQEIEDVMNEADENSNVLNGDLPTGQESAGFLQQLSILNSRSFKNMYRNPKLLLGNYVLTILLSLFLGTLYYNVSNDISGFQNRMGLFFFILTYFGFVTFTGLSSFALERIIFIKERSNNYYSPFAYYISKIISEVVPLRVVPPILLSLIVYPMTGLNMKDNAFFKCIGILILFNLGISLEILTIGIIFEDLNNSIILSVLVLLGSLLFSGLFINTSNITNVAFKYLKNFSVFYYAYESLLINEVKTLMLKERKYGLNIEVPGATILTTFGFVVQNLVFDIKILALFNVVFLITGYLALKWIVVEQK

SEQ ID NO: 101 - DNA, 3189 bp, Zygosaccharomyces rouxii
atgttgaaggtccaactacatgtgttgctgttactttttagtgttcaatggacccgtgtaatggggatcggtttcgaccaagttgaatttagaacgagaactacgttatcacggcccgatcgtgacagcgccggcggcgacgccgccgccggcggtaacggtgatggtgataaatgtccaccttgctttaattgtatgttaccaatttttgaatgtaaacaatattccgagtgtaattctaataccggtaggtgtgaatgtattccaggatttgcaggcgatgattgttctattcctgtctgtggtgggttagatgagccaaacggtagaaggcctcaacgtgacaatggatctgacacatgtcaatgtaaggcaggttggggtggtataaactgtaacatatgcgaggaagatttcgcatgtgacgcatttatgccagggcctgaattaaagggaacttgttataaaaatggtatgattgttaacaaatcttatcaaggttgtaatgtaaccaatgaaaaaattttacaaactcttaagggtagaattcctcaagtcaccttttcatgtgacaatcatacaaaggattgcaactttcaattttggatagacaggatagagagtttttactgtggactagatcgttgtcaattcgaatacgatttaaaatcaaattcttctcattacaattgtgaaagcgctagatgcaagtgtgttccaaacactactttgtgtggcgccaaaggatcaattgatatatctgactttttgacacaaaccgttaaaggtcctggtgattttgtatgtgatttgcaaacaaaaaaatgtaggttcagtgaaccctctatgaacgatttaatctcaacaatttttggcgatccttacattatgcttgagtgccgcggtggtgaatgtcttcattacagtgaaataccaggttacatgcctccagacaaggatatttccatgtcttggcaggcaaacctcattttagcgctaacttccgtgttagttttactgctagtgacttttgtcactttctgtatctctaagtcacctttgttcaaaaacgatccattagcattggaaggtgatgactttttatctggtggaggtggcggtggagctacaagtgcccaggagccttcagatgctaatttcctgaagactgatgtcgaggctgtcctaacgtttaaagatatcgtgtaccaagtgccaataaaccgtgacaattccgaaacggttcttaatgaagtcagtggagtagtacaaccaggtgagatgatggcgcttttgggtggatcaggcgctggcaaaaccacactcttagatattttagccatgaagaagaaagcgggtaaagtttctggtcagatcaaagtcaacgggaagtctatctctaagaaagattataccaaattaattggatttgttgatcaagatgattacttgttacaaacgttaacagtcttcgaaacagttctaaacagtgcattattacgtttaccgcgtgccttgccttttgaagcgaaaagatctagggtttacaaagtcttagaagaactaagaattttagatattaaggataaaatcattggtaatgagtttgaaaggggaattagtggtggagaaaagaggagagtgtctatcgcgtgtgaattagtgactagtccactgattctgtttttagacgaacccacatcagggttggatgccaacaatgcaagtaacgttgtagattgtttggtgagattagctagaaattacgggagaacgcttgtattgtcaatccatcaaccaagatcgaatattttccaaatgtttgataaactggtccttttaagtaatggtgagatggtctattccggtgaagccataagagttaatgaattcttacgcaataatggttaccaatgtcccacggaatacaacattgccgattatttgatagatatcacttttgaaacccaattgcaaagtaagaaaagagctagagccgctagtagtaggagtggtatgcaagtcacccctgatgtactccaaaatcccacttcgggtatagacgccaataagaatgcaattcacccagcgttggaagagggaagcggatccgtaccttcagttacgcaacgtgaatgggaacatttagctggtcatagggatgaaattagaactttactcaaagatagtgtatcacaagaacacgaaactgttggttccatgaataccagacttttgcataatcgtttcaaggatggtccctattatgcacaattgagtcatgatatagctaccattctcactaattatgcaacagctcaaatggaattaccatcgtcaatgaattcggcatcttttcctcaacagttatccattctctgttcgagaacatttaaaaatatttacagaaatcccaaactgttactggccaactatctcatgactctattgctaggtggatttttaggaacactttattacgatgtttctaatgacattagtggattccaaaacaggttgggacttttcttcttcattatgacatattttggatttgttacactgacaggtttgagttccttcgctgtggagagaattattttcattaaggaacgctccaataattactactcaccactagcctattatttcagcaaaattttgagtgatgttttaccattaagagtaattccaccggttatcttaggattggtcgtctatcccttagtggggctaaacatggataaccatgcctttttcaaatttattggaatcctagtgcttttcaatttgggtatatccttagaaattctatccattggtattatttttgaagacttgagcaactcgattatctttagcgtgctagttctgttgggatcactgctattcagcggacttttcatcaacaccaaagaaattacgagtgtcgctttcaagtatctcaagaatttctcccttttctattacgcctatgaatcgcttctaatcaacgaagtaaaatcattaatgctaagagaaaagaaatatggtttagatattgaagttccaggtgctacaatcttaagtactttcggattctcagtacagaatctggggttagatattaagatactgggagttttcagtactgtatttttgataatcggttatgtggctttgaaactgatagtggtggagcaaaagtag

SEQ ID NO: 102 - DNA, 3063 bp, Kluyveromyces thermotoleran
atgcgtccaaatgtcttcgcgataggcgtttttttttcaataaccacagtacttgctgaagactttgtgcagaggctgcccagcctacaaagttgtgacttacgaggcggattgcaaatagaagacgaaggagataagtgtccgccttgcttcaactgcatgctgccaatttttgagtgcaagcagttctctaaatgtaactctaatacaggaagatgtgagtgcctagaaggttttggcggcgcagactgttctgctcctttatgcggggcactatccaaaaataacgatgaccgaccgctccgcggcaacgatacgcagagctgtaagtgtgagcctggctggggcggcatcaactgtaatatatgtgaagaagactctgtttgcgatccatttatgcctgaagggttaaagggtacatgctataaagatggaatgattgtgaacaaattccatcaaggatgtgatgtcactaatgaaaaaatcgtccaaatattgaatggcaagaagccacaagttacgttttcctgcagcaaaagctcagaagagtgcaacttccaattttggattcaagaaatagagagtttctactgcggtttgaatgaatgcgagtttcagcatgatttaagcaacaatgtgtcgcactaccgctgtgaaaacgtgcaatgcaagtgcgtccctggtgagatgctttgtggccagaaaggatctatcgacatttctgaattcttaacggaaaccatcaaagggcccggggattttagctgcgacttaaagacaaaaaagtgtaagttcagcgagcctagtatgaataatctaattacaacagtttttggtgatccctacatcacactacaatgtgagtctggggagtgcgtacactacagtgaaattcccggatacgagcagccgtccaaagacaaactgtcgctttttcaaatcatagttttatcagcaacttctatggttgtagtggttctgacgttgcttgccgtcatttttgtctccaaaagtccactcttcaaaagcacgcctgtacagctggaggacgatgacagcaatgactttgattttctcaaatttggagtgaggtcaacgcttactttcgaagatatcagctatagcattacctccaataaaaaagaaatcaatttgttgaacggaataagtggttctgtgaggcctggtgaaataatggctctaatggggggttctggtgctgggaaaacaacattattagatattttggccatgaaggaaaaggccgggaaggtttcggggttaattaaggtcaacggcaaaggtgttacaaagcaaaacctcgcagaaattattggcttcgttgaccaggaggactttcttttgcctactttaactgtttatgagactgttttgaatagcgcacttcttcgcttacctagaaagatgagttttacggcaaagcaaaagcgagtctaccaagttctcgaggaactccgcatcatagacatcaaagatcgcatcattggtgatgactttgatagaggcatcagtggcggagaaaaaagaagagtttctatcgcttgtgagctcgtcacgtccccctcaatcttgtttttagacgagccgacctctggtttagactcaaacaacgctaacaacgttatcgagtgcttagttcgccttgcgctacactataacagaactttagttctctctattcatcaaccgcggtcaaacattttcaaatcttttgataagctcgttctgcttagccaaggcgagatggttttttctggagctgctacggatgtgagcgagtttctacgcaataacaattataattgcccgtctgattacaacatagcggattacctaatagacattacgtttgaatccacaaagccgggcatcatgtctccatcatatcccggggatattgaagcaaatttgcatgatcacccgagccactttccgcctcatatggatggtagcgatggaaggaaagactctgtaacagcaactcaaagtgaatgggagcattacgcggtgcatagggacgaattgcgttctttacttgaccaaagggatgaaaacgacaatgatgttggccttttaaacacaaagctcctgcatgctaagttcagagagggccaatacttctccagcctcctccaagaaattgagagcacaaaagcttcaccaacttctacggaagttgaggttttcagcagggtccaatcagcatctttcaaagagcaattgtttattctcttgtcgcgcaccttcaaaaatatttaccgaaaccctaaattgttgctggggaactatctcgtgactatcttaatgggttgcttccttggctcgctttattataacgttgaaaataacatcagtgggtttcaaaatcggctaggcttgttctttttcatattgacttactttgggtttttgacttttacagggctgacttcattttctttggaaagaatcatatttttgaaagagcggtcaaataactattactcaccaatggcctattacatcagtaagattctgagcgacgttttgcctctgagagtcgtgcccccaattcttctggccctggtagtgtatccaacagtggggctaaacatgagcaacaatgcgtttttcaagtttgttttgattttggttctcttcaacgttgggatttctttagagattttgactgttgggataatagttgaggatctcaacaactccattgttataagcgttttaattttactagcatctttgcttttcagtggacttttcatcaacacgaaagacatcagcaacatcgcatttaagtacttgaagaacttgtcgatattttactacgcatatgagtctttgatcattaacgaggtgaaatcgcttatcctcaaagaaaggaagtatgggctcgacattgaagtgccaggcgctaccattctgagcactttcgggttccttgttcagaacttcctgctagatattaaattgcttgttgcattcaacatcatgtttttggttctgggatacctgggcttgcaattgatagttatagaaaaaaaatga

SEQ ID NO: 103 - protein, 1062 aa, Zygosaccharomyces rouxii
MLKVQLHVLLLLFSVQWTRVMGIGFDQVEFRTRTTLSRPDRDSAGGDAAAGGNGDGDKCPPCFNCMLPIFECKQYSECNSNTGRCECIPGFAGDDCSIPVCGGLDEPNGRRPQRDNGSDTCQCKAGWGGINCNICEEDFACDAFMPGPELKGTCYKNGMIVNKSYQGCNVTNEKILQTLKGRIPQVTFSCDNHTKDCNFQFWIDRIESFYCGLDRCQFEYDLKSNSSHYNCESARCKCVPNTTLCGAKGSIDISDFLTQTVKGPGDFVCDLQTKKCRFSEPSMNDLISTIFGDPYIMLECRGGECLHYSEIPGYMPPDKDISMSWQANLILALTSVLVLLLVTFVTFCISKSPLFKNDPLALEGDDFLSGGGGGGATSAQEPSDANFLKTDVEAVLTFKDIVYQVPINRDNSETVLNEVSGVVQPGEMMALLGGSGAGKTTLLDILAMKKKAGKVSGQIKVNGKSISKKDYTKLIGFVDQDDYLLQTLTVFETVLNSALLRLPRALPFEAKRSRVYKVLEELRILDIKDKIIGNEFERGISGGEKRRVSIACELVTSPLILFLDEPTSGLDANNASNVVDCLVRLARNYGRTLVLSIHQPRSNIFQMFDKLVLLSNGEMVYSGEAIRVNEFLRNNGYQCPTEYNIADYLIDITFETQLQSKKRARAASSRSGMQVTPDVLQNPTSGIDANKNAIHPALEEGSGSVPSVTQREWEHLAGHRDEIRTLLKDSVSQEHETVGSMNTRLLHNRFKDGPYYAQLSHDIATILTNYATAQMELPSSMNSASFPQQLSILCSRTFKNIYRNPKLLLANYLMTLLLGGFLGTLYYDVSNDISGFQNRLGLFFFIMTYFGFVTLTGLSSFAVERIIFIKERSNNYYSPLAYYFSKILSDVLPLRVIPPVILGLVVYPLVGLNMDNHAFFKFIGILVLFNLGISLEILSIGIIFEDLSNSIIFSVLVLLGSLLFSGLFINTKEITSVAFKYLKNFSLFYYAYESLLINEVKSLMLREKKYGLDIEVPGATILSTFGFSVQNLGLDIKILGVFSTVFLIIGYVALKLIVVEQK

SEQ ID NO: 104 - protein, 1020 aa, Kluyveromyces thermotoleran
MRPNVFAIGVFFSITTVLAEDFVQRLPSLQSCDLRGGLQIEDEGDKCPPCFNCMLPIFECKQFSKCNSNTGRCECLEGFGGADCSAPLCGALSKNNDDRPLRGNDTQSCKCEPGWGGINCNICEEDSVCDPFMPEGLKGTCYKDGMIVNKFHQGCDVTNEKIVQILNGKKPQVTFSCSKSSEECNFQFWIQEIESFYCGLNECEFQHDLSNNVSHYRCENVQCKCVPGEMLCGQKGSIDISEFLTETIKGPGDFSCDLKTKKCKFSEPSMNNLITTVFGDPYITLQCESGECVHYSEIPGYEQPSKDKLSLFQIIVLSATSMVVVVLTLLAVIFVSKSPLFKSTPVQLEDDDSNDFDFLKFGVRSTLTFEDISYSITSNKKEINLLNGISGSVRPGEIMALMGGSGAGKTTLLDILAMKEKAGKVSGLIKVNGKGVTKQNLAEIIGFVDQEDFLLPTLTVYETVLNSALLRLPRKMSFTAKQKRVYQVLEELRIIDIKDRIIGDDFDRGISGGEKRRVSIACELVTSPSILFLDEPTSGLDSNNANNVIECLVRLALHYNRTLVLSIHQPRSNIFKSFDKLVLLSQGEMVFSGAATDVSEFLRNNNYNCPSDYNIADYLIDITFESTKPGIMSPSYPGDIEANLHDHPSHFPPHMDGSDGRKDSVTATQSEWEHYAVHRDELRSLLDQRDENDNDVGLLNTKLLHAKFREGQYFSSLLQEIESTKASPTSTEVEVFSRVQSASFKEQLFILLSRTFKNIYRNPKLLLGNYLVTILMGCFLGSLYYNVENNISGFQNRLGLFFFILTYFGFLTFTGLTSFSLERIIFLKERSNNYYSPMAYYISKILSDVLPLRVVPPILLALVVYPTVGLNMSNNAFFKFVLILVLFNVGISLEILTVGIIVEDLNNSIVISVLILLASLLFSGLFINTKDISNIAFKYLKNLSIFYYAYESLIINEVKSLILKERKYGLDIEVPGATILSTFGFLVQNFLLDIKLLVAFNIMFLVLGYLGLQLIVIEKK

SEQ ID NO: 105 - DNA, 3183 bp, Saccharomyces castelli
atgctgattcaaagttctgtactgttaatatggttgcaactgctatatttaactaccgaggtggttcaatcgaggtccaatcaagtaccattccctcccaaaaactacaaagaagatgaccttctactaaacattcctaaccgacctagaaacccggatggagagtgtccaccttgtttcaattgtatgctaccgatgtttgaatgtaagcaattctcagaatgtaattcgtatacaggtagatgtgattgtattgaaggttttgccggtgacgattgtgccttaccgttatgtgggtcccttgagaaggggaacaatgaaagacccatcaggtctaatgatactaatacatgtcaatgtgacgatgggtggggcggtatcaattgtaatatttgtcagatggattccgtgtgtgattcattcatgccggatccatcattgaagggtacttgttacaaaggtggtattgtcgttaataaattatttcaaggctgtgatgttactaatgaaaaaatattacaagtgttgaaaggtaagaaaccacaagtcaccttctcgtgtgatgagactacgaaggaatgtaatttccaattctggattgatcaaattgaaagtttctactgtggattagatacgtgttcctttgattacgatctttctggcaattcaactcattatgtttgtcaggatgctaaatgtaaatgtatccccgggacaatgttatgtggtgccaatggatccattgatattggagaattcttgacagagactattaagggaccaggtgattttacttgtgatttggaaactaaaaaatgtaaatttagtgaaccttctatgaacgaattaatttcagacgtatttggtgatccatatattatgttacattgtgaatcaggtgaatgtatccattatagtgaaattccaggttacaaatctccatcaaatgacaagggaatgtcatgggaggaaaatttaatattagctttaactagtatcggtgtactagcattggttacatttgttagtttctatattgcaaagtcacctttatttagaaatgggaatgatggcaaaatccatctaccagatgatgccgatagtggagatggtgttggtactgctgctgcaggtgataattttttgaaatctgaaacttctgccacattatcgtttgaaaatataacatatgaagtacccagtttgaataaaaatcacaaatctcagccaaattcgaatgtaaaagtgttgaagagtatagacggtattgtaaaaccgggacagatatttgccattatgggtggatccggtgccggtaaaacaacattattagatattctagcgatgaaacgtaagactggtcaagttggtggtgaaattaaagttaatgggaatataatgtcaagaaaatcatattccaagttgattggatttgttgatcaaaatgattatttacacccaacattgacagtctatgagactgttttgaatagtgcattattaagattgcccagaacaatgtcatttgaatccaaacaatccagagtgtttcaaattcttgaagaattaagaatatttgacattaaggatagaataatcggtaatgattttgaaagaggtattagtggtggtgaaaaacgaagagtttccattgcatgtgaattagtcacgtctccattgattttatttctagatgaacccacatcaggtttggatgctaataatgccaataatgtgattaccagtcttgttagacttgccaagaattataatagaacgttgatattgactattcatcaaccaagatcgaacattttcaatcaatttaataaactagtattgttaagtcaaggtgagatggtattttccggtgattccattaagatacatgagttcttgtataataatggatatgaatgtccaatcaattataatattgctgattatttgattgatatcacatatgaatccaagaagaaggtcaaaaaaccttccaatctagaagatctagaagttggtccattacaaattgaaggtgaaatagatcctaatagtacagatagtgttgccaaacaagggttacgtcgtagtactacacaggcggaatgggagaattttgccgctcatagagaagaattacaaaccattttaagtacccatgatgaggatcaagaagaagagacagttggatcattgaatactatgatattacatggtaaattcgtggaaggttcgtattacggtgaattactcaatgaaattaaggaagtttctgccactggaactacctctaatacaggacgaggatctgatgttactggtgatatggaaataccaaagagtgccacatttattcaacaattgagtattctatgttcacgaactttcaagaacatttatcgtaatcccaaattattaattggtaattttgcattaacgatcttattgagtatattcttaggaacgttatattatcaattaagcaatgatataagtgggtttcaaaatcgtatgggattatttttctttatgttaacctattttggatttgttactttcactggattaagttcattctcattagaaaggttgattttcattaaggaaagatcgaataattattattctccgctggcttattataccagtaagattttaagtgatgtgttacccttaagagtgattcctcctattttaatggctataataatatacccgatggcaggattaaatatgagaaatgaaggatttttcaaattcattgggatattaattcttttcaatttgagtatttcattagagattttgactattggtataatttttgaagatttgaataatgggatcatcttaagtgtcctggttcttctagggtctttgttattcagcgggttattcattaatacgaaagatattacgaatgtggcatttaaatacttgaagaatttctcagtattttattacgcgtatgaatcgttactgattaatgaggttaagacgttaatgttaaaggagaagaaatatggattaaatattgaagttcctggtgcgacaatcttgagtacatttggattcatggttcaaaatttacaatttgatattgaaatattgggggtgtttaatgttgtgtttttgattgttggatatttggcattgaaatggattgtcgttgaacaaaagtag

SEQ ID NO: 106 - protein, 1060 aa, Saccharomyces castelli
MLIQSSVLLIWLQLLYLTTEVVQSRSNQVPFPPKNYKEDDLLLNIPNRPRNPDGECPPCFNCMLPMFECKQFSECNSYTGRCDCIEGFAGDDCALPLCGSLEKGNNERPIRSNDTNTCQCDDGWGGINCNICQMDSVCDSFMPDPSLKGTCYKGGIVVNKLFQGCDVTNEKILQVLKGKKPQVTFSCDETTKECNFQFWIDQIESFYCGLDTCSFDYDLSGNSTHYVCQDAKCKCIPGTMLCGANGSIDIGEFLTETIKGPGDFTCDLETKKCKFSEPSMNELISDVFGDPYIMLHCESGECIHYSEIPGYKSPSNDKGMSWEENLILALTSIGVLALVTFVSFYIAKSPLFRNGNDGKIHLPDDADSGDGVGTAAAGDNFLKSETSATLSFENITYEVPSLNKNHKSQPNSNVKVLKSIDGIVKPGQIFAIMGGSGAGKTTLLDILAMKRKTGQVGGEIKVNGNIMSRKSYSKLIGFVDQNDYLHPTLTVYETVLNSALLRLPRTMSFESKQSRVFQILEELRIFDIKDRIIGNDFERGISGGEKRRVSIACELVTSPLILFLDEPTSGLDANNANNVITSLVRLAKNYNRTLILTIHQPRSNIFNQFNKLVLLSQGEMVFSGDSIKIHEFLYNNGYECPINYNIADYLIDITYESKKKVKKPSNLEDLEVGPLQIEGEIDPNSTDSVAKQGLRRSTTQAEWENFAAHREELQTILSTHDEDQEEETVGSLNTMILHGKFVEGSYYGELLNEIKEVSATGTTSNTGRGSDVTGDMEIPKSATFIQQLSILCSRTFKNIYRNPKLLIGNFALTILLSIFLGTLYYQLSNDISGFQNRMGLFFFMLTYFGFVTFTGLSSFSLERLIFIKERSNNYYSPLAYYTSKILSDVLPLRVIPPILMAIIIYPMAGLNMRNEGFFKFIGILILFNLSISLEILTIGIIFEDLNNGIILSVLVLLGSLLFSGLFINTKDITNVAFKYLKNFSVFYYAYESLLINEVKTLMLKEKKYGLNIEVPGATILSTFGFMVQNLQFDIEILGVFNVVFLIVGYLALKWIVVEQK

SEQ ID NO: 107 - DNA, 1854 bp, Kluyveromyces waltii
atgagtgcatctggcgcagggaaaaccacgcttcttgactgcttggcttcaagagttacaatgggcactattacaggtgacatgttcatcaatggtttcctgcgtgacgattccttcgcgaggtccattgggtactgtcagcaacaggatttgcatttagaaactgcaacagtgagagaatctctgagattctctgcttacttacgccagcctgcgtctgtatcaattgcggagaaaaacaagtatgttgacgaggttatcaagattttagagatgcaaaagtacgctgacgccgttgtcggtgtggccggtgaaggacttaatgtggagcaacgtaagagactgactatcggtgtggaacttgcagctaagcctaaattgttactcttcttagatgagcctacgtccggtctcgactcccaaacagcctggtccatctgccagttgatgagaagattagcgaatcacggccaagctattctctgtaccattcaccagccatcagccttgctgatgcaagagttcgataggttgctattcttgcaacgtggcggtagaacagcttattttggtgagttgggtgaaggttgtcaaaagatgatagattattttgaaaagcatggcgcacacccatgtcctcagggagcaaatccagctgaatggatgttagaagttattggtgccgcccctgggtctcatgctaatcaggattataacgaagtgtggagaaactctgaagaatacaaagctgtacaagaggaacttgaatggatggaacgcgaacttcccaagaaacctattgacactagcgaagaacatagcgagttctcaacgtctttgccttaccagtatatgctggtaaccaaaagactaatgcaacaatactggagaactccctcttacttgtggtcgaagctcattctgactgtaatctcccaaattttcattggcttcacctttttcaaagcagatagctcattgcaggggttacaaaaccaaatgctttcggtgttcatgttcactattgtgttcaatccctccttgcagcagtacttgccaactttcatttcccaaagagatttatatgaagctagggagcgtccctccagaacgttctcatgggtagcatttattttgtcgcaaattaccgtggagataccttggaacttcctagtaggaactattggttttttcctctattattacccggtcagtttctaccgtaatgcttcctttgccggtcaattatcagaaagaggtgctcttttctggctcttgtgcaccgcattttacgtcttcacaggttcaatggctcagttatgcgtagcaggatttgagcttgccgacactgctggcaatcttgcttctctactattcacaatgtctctgtcgttttgcggagttatggttacgccaaagaacatgcctggattttggattttcatgtacagagtatctccgctcacctactttatcgacggagctatgtcaacgggtcttgccaacgctgaagctcgttgctccgggtatgagatggtatcgttccaacccccttccggccaaacgtgtggtcagtatatgtcaccttacattaaatctgttggtaccgggtatctttctaatccgggagcgaccgaaaactgttctttctgcacagtttcttcaacgaatgactttttgaaatctgtaagttcctcttacagtaccagatggagaaactatggaattttcttgtgcttcattttcttcaattttggcatggctattttcttgtactggttggcaagagttcctaagagtaaaaacagagtggcagacgaaagaaagcccgacagcgctaaaacgaataaatga

SEQ ID NO: 108 - protein, 617 aa, Kluyveromyces waltii
MSASGAGKTTLLDCLASRVTMGTITGDMFINGFLRDDSFARSIGYCQQQDLHLETATVRESLRFSAYLRQPASVSIAEKNKYVDEVIKILEMQKYADAVVGVAGEGLNVEQRKRLTIGVELAAKPKLLLFLDEPTSGLDSQTAWSICQLMRRLANHGQAILCTIHQPSALLMQEFDRLLFLQRGGRTAYFGELGEGCQKMIDYFEKHGAHPCPQGANPAEWMLEVIGAAPGSHANQDYNEVWRNSEEYKAVQEELEWMERELPKKPIDTSEEHSEFSTSLPYQYMLVTKRLMQQYWRTPSYLWSKLILTVISQIFIGFTFFKADSSLQGLQNQMLSVFMFTIVFNPSLQQYLPTFISQRDLYEARERPSRTFSWVAFILSQITVEIPWNFLVGTIGFFLYYYPVSFYRNASFAGQLSERGALFWLLCTAFYVFTGSMAQLCVAGFELADTAGNLASLLFTMSLSFCGVMVTPKNMPGFWIFMYRVSPLTYFIDGAMSTGLANAEARCSGYEMVSFQPPSGQTCGQYMSPYIKSVGTGYLSNPGATENCSFCTVSSTNDFLKSVSSSYSTRWRNYGIFLCFIFFNFGMAIFLYWLARVPKSKNRVADERKPDSAKTNK

SEQ ID NO: 109 - DNA, 4629 bp, Candida glabrata
atgaacacacccgatgactctagtgtctcgagtgtagactcgcatcagccctatatgggttttgatgacaacgtcgagaaacgtatacgggagctcgcccggtcgctgacccagcagagcttaacgtcgtcaaaccggtccgtaaacaaagaggcccccgcagatggcagcgcgccattggacagagtctcaacgcgggcgtcctccattttcagcgcggactttaaaggtgtcaaccctgtcttttcggacgaggaggaagacgactacgatgcccgtctggaccccaacagcgatgagttctccagtaaagcgtgggtccagaacatggccaagatcacaactggggacccggagttctacaagccgtactcgatcgggtgctgctggaaggacctgagcgcctctggtgagtccgccgatgtgtcataccagagcactttcctgaacctgcccgtgaagctgctaaacgccgtctggcgtaaggcgagacccgccagagagagcgatacattccgcatcctgaagcccatggacgggctgttgaagcccggtgagctgcttgtggtgctgggcagacccggttccggttgtaccacgctgctgaagtccatctcctcgaccacgcacgggttccagattagcaaggactccgtgatctcctacaatggcctgacgcccaacgagatcaagaagcactaccgtggtgaagttgtgtacaacgccgaggcagatatccacctgccccacctgacggtataccagacattggtcactgtggccaggttgaagaccccacagaaccgtgtcaaaggtgtcaccagagaggacttcgccaaccatgtaacagatgtcgctatggccacctacggtctttcccacacaagggacacaaaggtcggtaatgacctggtcagaggtgtctccggtggtgagcgtaagcgtgtgtctatcgctgaagtgtggatctgtggctcaaagttccaatgctgggataacgctacgagaggtctcgactctgccactgcgctggaattcgtaagagctctgaagacacaggcacacattgcaaaaaatgtggccaccgtggctatctaccagtgttcgcaagacgcctacaatctcttcaacaaagtatccgtgctttatgaaggctaccagatttattttggtgacgcccagcacgcaaaggtatacttccagaagatgggttacttctgtcctaagagacagaccatccctgacttcttgacttcgatcacttcacctgcagagagaagaataaacaaggagtacttggataaaggcattaaagtgccacagacgccattggatatggttgagtactggcacaactccgaggaatataagcaactaagagaagagatagacgaaacactggcacatcaatcagaagatgataaagaagaaattaaagaagcccacatcgctaagcaatcaaagagagctagaccctcatccccatatgtggtaagctacatgatgcaagtcaagtatattctcataagaaatttctggagaattaaaaatagtgcaagtgtcacgttattccaagtcttcggtaattcagcaatggccttcattctgggatctatgttctacaaaattcaaaagggttcttctgctgacactttctatttcagaggtgcagccatgttctttgccatcttgtttaatgctttctcctctttgctggaaattttctctttatatgaggcaagaccaatcaccgaaaaacacagaacatattctctataccacccaagtgctgacgcttttgcatctgttatatctgaaatcccaccaaagattgttacagctattcttttcaatatcatcttctatttcctggtgaacttcagaagagatgctggtagattcttcttctatttcctaatcaatgttatcgctgtttttgccatgtcccatcttttcagatgtgttgggtctttaacaaagactttacaagaggccatggtacctgcatcgatgttattgttggcgctatcaatgtatactggttttgctattcctcggacaaagatgttaggttggtcaaaatggatctggtacatcaaccctcttgcatacctatttgaatctttgatggtcaatgaattccatgatcgtagattcccatgtaacacttatattcccagaggcggggcatataacgatgttacaggtaccgaaagagtatgtgcatccgttggtgcaagacctggtaatgattatgttcttggtgatgacttcttgaaggagagttacgattacgaaaataaacacaagtggcgtgggttcggtgttggtatggcctatgttatcttcttcttctttgtgtacttaattctgtgtgagttcaatgaaggtgctaaacagaaaggtgaaatgctagttttccctcatagcgttgttaagcgtatgaagaaggagggtaaaattcgtgacaagacgaagatgcacacagacaagaatgatatcgagaacaactccgaatctataacctccaatgcgaccaacgaaaaaaacatgctacaagatacatatgatgaaaatgctgattctgagtccattaccagtggaagtagaggtggtagccctcaagttggtttatctaaatcagaagcaatctttcattggcaaaatctgtgttatgatgtaccaatcaagacagaggtaagaagaatcttgaacaatgtcgatggttgggttaaaccaggtacactaactgctttaatgggtgcatccggtgcaggtaaaacaacattattggattgtttggctgaaagaactacaatgggtgttattacaggtgatgttatggttaatggtagaccaagagatacttcattttcaagatctattggttattgtcagcaacaagatttacatttgaaaactgcaacggtaagagaatcgctaagattttcagcttacttgagacaaccttctagtgtatcaattgaagaaaaaaatgaatatgttgaggctgttattaagatcctagaaatggaaacttacgcagatgcagttgttggtgtccctggtgaaggtttgaatgttgaacaaagaaaaagattaactattggtgttgaattagctgcaaagccgaaattgttagtgtttttggatgaaccaacttctggtttggattcgcaaaccgcttgggcaacatgccaactgatgaagaaactggcaaaccacggacaagcaatcttatgcactattcaccaaccttctgctatgctaatgcaggaatttgacagattgctgttcttacaaaagggtggtcaaactgtttattttggtgacttgggtaaaggatgtaaaacaatgatcaaatactttgaggatcatggtgcacataaatgccctccagatgcaaatccagctgaatggatgttagaagtagttggagcagctccaggctcacatgcaaaccaagactaccatgaggtgtggagaaattccgaacagttcaaacaagttaaacaagaactagaacaaatggaaaaagagctttcccaaaaggagctggataatgatgaggacgctaataaggaattcgcaacatcgctatggtatcaattccagcttgtctgtgtgagattatttcagcagtattggaggactccggactacttatggtccaagtacattttgactatctttaatcaactgtttattgggttcacatttttcaaagcagatcatactttacaaggcttacaaaatcaaatgctttctattttcatgtacacagttattttcaacccgttactacagcagtacttgcctacatttgttcagcaaagagatttatatgaagcaagggaacgcccatctagaactttctcatggaaggcatttatattggctcagatagtggtagaagttccttggaatatcgttgctggtacattagcctactgtatctactattactctgttggtttctatgctaatgcctctcaagcccaccagttgcacgaaagaggtgcattattctggttgttttccatcgcgttttatgtttatgttggatccttaggtctatttgttatttcattcaacgaagttgctgagactgccgctcacattggttccttaatgttcacaatggccctatcattttgtggtgtgatggctactccagatgccatgcccagattctggattttcatgtacagagtctcaccattaacctatttgattgatgcattattatccacaggtgtggctaatgttgatatcagatgctctaatacagaactggtcacatttactccgccacagggcttaacatgtggtcaatatatgactccttatctgaatgtagcaggtactggatatttaactgatccatctgctaccgatgaatgtcatttctgtcaattctcttacaccaatgatttcttggccactgtgagttccaaatactacagaagatggcgtaattatggtatatttatttgtttcattgtatttgattatgtggctggtatcttcctctattggctggcaagagtgcctaaaaccaatggtaaaattgctaaaaacggtaaaacagccaaggttaattttattagaaggttaattcccttctag

SEQ ID NO: 110 - protein, 1542 aa, Candida glabrata
MNTPDDSSVSSVDSHQPYMGFDDNVEKRIRELARSLTQQSLTSSNRSVNKEAPADGSAPLDRVSTRASSIFSADFKGVNPVFSDEEEDDYDARLDPNSDEFSSKAWVQNMAKITTGDPEFYKPYSIGCCWKDLSASGESADVSYQSTFLNLPVKLLNAVWRKARPARESDTFRILKPMDGLLKPGELLVVLGRPGSGCTTLLKSISSTTHGFQISKDSVISYNGLTPNEIKKHYRGEVVYNAEADIHLPHLTVYQTLVTVARLKTPQNRVKGVTREDFANHVTDVAMATYGLSHTRDTKVGNDLVRGVSGGERKRVSIAEVWICGSKFQCWDNATRGLDSATALEFVRALKTQAHIAKNVATVAIYQCSQDAYNLFNKVSVLYEGYQIYFGDAQHAKVYFQKMGYFCPKRQTIPDFLTSITSPAERRINKEYLDKGIKVPQTPLDMVEYWHNSEEYKQLREEIDETLAHQSEDDKEEIKEAHIAKQSKRARPSSPYVVSYMMQVKYILIRNFWRIKNSASVTLFQVFGNSAMAFILGSMFYKIQKGSSADTFYFRGAAMFFAILFNAFSSLLEIFSLYEARPITEKHRTYSLYHPSADAFASVISEIPPKIVTAILFNIIFYFLVNFRRDAGRFFFYFLINVIAVFAMSHLFRCVGSLTKTLQEAMVPASMLLLALSMYTGFAIPRTKMLGWSKWIWYINPLAYLFESLMVNEFHDRRFPCNTYIPRGGAYNDVTGTERVCASVGARPGNDYVLGDDFLKESYDYENKHKWRGFGVGMAYVIFFFFVYLILCEFNEGAKQKGEMLVFPHSVVKRMKKEGKIRDKTKMHTDKNDIENNSESITSNATNEKNMLQDTYDENADSESITSGSRGGSPQVGLSKSEAIFHWQNLCYDVPIKTEVRRILNNVDGWVKPGTLTALMGASGAGKTTLLDCLAERTTMGVITGDVMVNGRPRDTSFSRSIGYCQQQDLHLKTATVRESLRFSAYLRQPSSVSIEEKNEYVEAVIKILEMETYADAVVGVPGEGLNVEQRKRLTIGVELAAKPKLLVFLDEPTSGLDSQTAWATCQLMKKLANHGQAILCTIHQPSAMLMQEFDRLLFLQKGGQTVYFGDLGKGCKTMIKYFEDHGAHKCPPDANPAEWMLEVVGAAPGSHANQDYHEVWRNSEQFKQVKQELEQMEKELSQKELDNDEDANKEFATSLWYQFQLVCVRLFQQYWRTPDYLWSKYILTIFNQLFIGFTFFKADHTLQGLQNQMLSIFMYTVIFNPLLQQYLPTFVQQRDLYEARERPSRTFSWKAFILAQIVVEVPWNIVAGTLAYCIYYYSVGFYANASQAHQLHERGALFWLFSIAFYVYVGSLGLFVISFNEVAETAAHIGSLMFTMALSFCGVMATPDAMPRFWIFMYRVSPLTYLIDALLSTGVANVDIRCSNTELVTFTPPQGLTCGQYMTPYLNVAGTGYLTDPSATDECHFCQFSYTNDFLATVSSKYYRRWRNYGIFICFIVFDYVAGIFLYWLARVPKTNGKIAKNGKTAKVNFIRRLIPF

SEQ ID NO: 111 - DNA, 4494 bp, Ashbya gossypii
atggaattttttaacgcaaatttgacagcgaatagagcatcccatgtatcggcaggtgccagcacgagcataggcgaagctgatcggccctatgtaggcttggcagaagatcttgaggagcaagaggtaattcgctcgctagcacagacgctgagccggtcatctgctgctgagtacgaattgcagcccacatcagccgatccctccgcattgttcgggcctgacaaggatgcccggctagaccctgagtcggatgagttcgatccgcgatactgggtgcgcacgatacgcaatctgtacgccagcgaccctgaccactataaacctgcggaactgtgtgtggtgattcagaacttgcgtgtatgcggtgtgtcggcagacacagattaccaggcgacggttggaaactcgccgttgaaggctttgcggatgttgtaccagatgacaccttttgcacgtggtcgggaaaaaagcgaatttgacatactaaagccgttggacgtggtgtttgagcccgggaggctgtgtgttgtgttagggcgccctggcgcgggctgctccaccctactcaaaacagtgggtgcacggacgtacgggtttaccgttgctccagaatcggagatcagttacagcggattttcgcagaaggagataaaaaatcacttgcgtggggaggtgatctactccgcagagtctgacacacatttcgcgagtctgccagttggatatacgctagagtttgcggctcggtgtcgctgtccgcaggtacgtcctggtggggttaagcgcgaagtattttacaagcattatgcagccgccgtgatggcaatgtatgggctctcgcatactcgctataccaaagtgggcaacgactacataaggggtgtatctggcggcgagaggaagcgcgtgtcacttgcagaggttactttggcgggcgcgaagctccaatgctgggataactgcacccgtggactggactctgcaaccgctctggagtttgtgcgtgcgctaagggataacgcggaggtgatgcggacgacacagctcatcgcaatttatcagtgctctgaagctgcctatagcctatttgacgatgtgttggtgctatatgagggttatatgatctactttgggccacgtaagttagctaagggctactttttgcgcatgggctgggaatgccctccgcgacagacttctgcagacttcttgacgtctgttacatcgcctttcgaaagaaagtcacagcccgggtatgaggacaaggtaccccgcacagcgcgggaattctacgaatattggctacgttcaccggagcacgcggttgctatgaaacaaatccaaaggaggatagctgaggcaaagacggatgcagcccgtgaacagcttagggatcaccatatagtgcgccaggctaggcatgtaaagtcatcttcgccttatttaatttccttctacatgcaatttcgcgccattgtggatcgtaactggcaacggctgaggggtgatccgtcagtttacctgttttcgattgtcgcatactccatcatgggcttgatcctcgcctcgtgttttttgaatctaaaaccggatacaaattcgttgtttaataggggttccgcgttattcaccgctgtcctactgaactctttcttctcatttctggaaatcatgtctttgtttgaggcgcgtgcaattgttaagaagcacaagtcatacgccttctatcgtccttctgctgatgcattcgcttcgatatttacagagctacccgctaagttcaccgtctgtatctgtttcaatgtgcccttctatttcatggtgaacttgagaaggtctacaggagcgttcttcttttatatgcttgtatccctgactgccaccttcgcgatgtctcatttattccgtagtgttggtgctgcctgtaaaacgctttatgtcaccatgtttcctgcttctttgctcctgcttggcctggccgtttacgttggttttgttattcctcagaagaacatcttaggctggtccagatggctcttctatttaaatccaatcgcacgcatcatggaagccatggttgcgaatgaatttgacggacgcatattcgaatgttctcgaatggtacccgatggtagtttctatgagggattccctatttcgaataaagtctgcttgtcggtgggagcagttcctggtcagagctttgtaaatgggacccgttacatagagtttgcttatggttacaacaccaaaaacaagtggatgaattgggggatcgttcttgcttatgcatttttcttcttaggtgtttatctgatcttaattgagtataataaaagtgggatgcaaaaaggtgaaatggctgtattcctaaggtcaactttgaagaaaataaaaaagcaaaataaaaaggccatcaactgcgacatagaatttggtaatgcaccaggaaaggaatctagtactataggaagtgaccaatcccgcgaacttattcagagaattggttctgatagcattttccactggcgagatgtctgctatgatatacagattaagaatgaaaccaggaggatcctaaccaacgtggatggttgggtaaagcctgggactttgactgctctgatgggttattcaggtgcaggtaagacgacattgttggatgttttggccaatagagttcgggtgggtgttgtaactggtaatatttttgttgatggacacctcagagacacttcttttcaacgtaagacagggtattgccaacaacaagatcttcatggacgtactcaaactgtgcgtgatgcgctaaaatttagtgcatacctacgccagccccaatccatttcgagagctgaaaagaacgcttatgttgaggatataattaaattactgggaatggaagcttatgctgacgctgttgttggagtcaccggcgaaggactgaacgttgaacagaggaagcgcttaaccattggcgtcgaactcgtggcaaaaccagaactgttgctgtttttggatgaacccacctcaggtttagactcgcaaactgcgtggtctatctgtcaactaataaaaaagttggttaatcatggtcaagcaattctgtgtacgattcaccaaccttctgccattttaatgcaggagtttgatcgcctgttgctcttgtctaatggtggtagaacagtttactttggccctttgggtgaaggatgttcgactatgatccagtactttgagaaccatggatcccaaaaattccctgaagcgtgtaatcctgcggaatttatgcttgagattattggtgctgcacctggttcccatgctcttcaagactatcacgaaatttggaagaactccgatgagtatcagtcagttcaggaagaattacatagaatggagatggaactttggcataaaccgagattcgaaacttcagatcagaacaaagaatttgcctcttccatatggtatcaatacatcatcgtatctagaagagtgctacaacaatattggaggtcgccagaatatttatggagtaagattttcatgagcatatttgcctctctttttatcggtttctctttcttcaagtcgaagacctctatccaagggttacagaatcaaatgtttgcagttttcctatttctagtagttcttactcccttggttcagcagatgctcccgcaatatgtggagcaaagggacttgttcgaagtgagagagagacattcgaagacattttcctggaaagtgttccttctatcccaaattaccgcagagattccctgggcgatattgggcgctacaatatcctttttctgcttttattatccagttggattttacacacatgctaccgacgcagcaaaccgggcagagcgtggattccttttttggtcgctatgcgtagccttctatatcttctcggctacctttggacaattttgtattgccggcttagagaaagcagaacctgcggcgatattggccaacttttacttcaccatgtgtttaatcttcagtggtgttttagttaccaaggataatctacctcgtttctggatatggatgtattatctctctccagtaacatacttagtttctgcccttctgtcgaccggttcgggtaatatgactgttgaatgtgcccctgaggaactaataaaattcgctccgccaaaaggactcttttgtgcactttaccttgagccgtttgcaaataatgcagaatcggtattgctcaaccctgcagccactgatctttgtacagtctgccctataaagaattcggactattatcttgcgttagttaacattttctacaatcacagatggagggattgggggattttcacgatatttgtagcaacaaatatcatagggtttgctgcaacttattggttctttcgtgttcctaagtccactcatatcaccatcaagaccaaggcaaatgtaaaagagcaagagcaagagcaagagcatcagtaa

SEQ ID NO: 112 - protein, 1497 aa, Ashbya gossypii
MEFFNANLTANRASHVSAGASTSIGEADRPYVGLAEDLEEQEVIRSLAQTLSRSSAAEYELQPTSADPSALFGPDKDARLDPESDEFDPRYWVRTIRNLYASDPDHYKPAELCVVIQNLRVCGVSADTDYQATVGNSPLKALRMLYQMTPFARGREKSEFDILKPLDVVFEPGRLCVVLGRPGAGCSTLLKTVGARTYGFTVAPESEISYSGFSQKEIKNHLRGEVIYSAESDTHFASLPVGYTLEFAARCRCPQVRPGGVKREVFYKHYAAAVMAMYGLSHTRYTKVGNDYIRGVSGGERKRVSLAEVTLAGAKLQCWDNCTRGLDSATALEFVRALRDNAEVMRTTQLIAIYQCSEAAYSLFDDVLVLYEGYMIYFGPRKLAKGYFLRMGWECPPRQTSADFLTSVTSPFERKSQPGYEDKVPRTAREFYEYWLRSPEHAVAMKQIQRRIAEAKTDAAREQLRDHHIVRQARHVKSSSPYLISFYMQFRAIVDRNWQRLRGDPSVYLFSIVAYSIMGLILASCFLNLKPDTNSLFNRGSALFTAVLLNSFFSFLEIMSLFEARAIVKKHKSYAFYRPSADAFASIFTELPAKFTVCICFNVPFYFMVNLRRSTGAFFFYMLVSLTATFAMSHLFRSVGAACKTLYVTMFPASLLLLGLAVYVGFVIPQKNILGWSRWLFYLNPIARIMEAMVANEFDGRIFECSRMVPDGSFYEGFPISNKVCLSVGAVPGQSFVNGTRYIEFAYGYNTKNKWMNWGIVLAYAFFFLGVYLILIEYNKSGMQKGEMAVFLRSTLKKIKKQNKKAINCDIEFGNAPGKESSTIGSDQSRELIQRIGSDSIFHWRDVCYDIQIKNETRRILTNVDGWVKPGTLTALMGYSGAGKTTLLDVLANRVRVGVVTGNIFVDGHLRDTSFQRKTGYCQQQDLHGRTQTVRDALKFSAYLRQPQSISRAEKNAYVEDIIKLLGMEAYADAVVGVTGEGLNVEQRKRLTIGVELVAKPELLLFLDEPTSGLDSQTAWSICQLIKKLVNHGQAILCTIHQPSAILMQEFDRLLLLSNGGRTVYFGPLGEGCSTMIQYFENHGSQKFPEACNPAEFMLEIIGAAPGSHALQDYHEIWKNSDEYQSVQEELHRMEMELWHKPRFETSDQNKEFASSIWYQYIIVSRRVLQQYWRSPEYLWSKIFMSIFASLFIGFSFFKSKTSIQGLQNQMFAVFLFLVVLTPLVQQMLPQYVEQRDLFEVRERHSKTFSWKVFLLSQITAEIPWAILGATISFFCFYYPVGFYTHATDAANRAERGFLFWSLCVAFYIFSATFGQFCIAGLEKAEPAAILANFYFTMCLIFSGVLVTKDNLPRFWIWMYYLSPVTYLVSALLSTGSGNMTVECAPEELIKFAPPKGLFCALYLEPFANNAESVLLNPAATDLCTVCPIKNSDYYLALVNIFYNHRWRDWGIFTIFVATNIIGFAATYWFFRVPKSTHITIKTKANVKEQEQEQEHQ

SEQ ID NO: 113 - DNA, 4467 bp, Ashbya gossypii
atgttaagccaccatccatcaacgtgtccagacccgcagcgatacatgatagaggctacagggccgcagtgggcgaaaacggaaggccatgatagccggacttcgctcagcgggtcttctgcgccagagctggtggcatatgggagcgaagcgggcgcggaggaacgcgaacggctgtcgcgagtgatgacgctgcagtcgatgggggaggcgcgcgcggcgttggaccctggcatggcgcagaaagtggaaagcctggcacggacgctgtcgcagcataccgtgcgggatgggcggctggtggttgatccggctgacttcgacatgaaggcaatcctgtcggggctggtgagcgcgtcgcagcggcaggacattccgatgcggcagaccggggtgctggttgagggggtgacggtgcagggcgtggactcgagctgcgtggaaggccacgactacggggacgtgcttgcgttgccgctgacggcggtgcgggcggtgcggcaggcgatgcggcggcggtaccgcaacattctggagtcggtgaccctgctggcgcggccgggggagatggtgctggtgctggggcggccgggcgcggggtgcacgtcgctgctgaagacggttgctggggagacagaccagtttcacagcgtggagggcgcaatctcctacgacgggatccctcagcgggagatgatgcggcggtaccgcgcggaggtggtgtacaatagcgagatcgacgtgcactttccgcacctgacggtgaagcaaacgctggactttgcgttggcgtgcaaaacgccgcacatgcgcgtgaacaacgtgtcgcgtgcggagtacatcacgctgatgcgggagctgtacgcgaccgtgtttggtctgcgccacacctacgacacaaaggtgggcaacgactacatccgcggtgtttcgggcggcgaacgcaagcgggtgtccattgcagaggccttggcggccaatgcgtcagtgtactgctgggataacgccacgcgggggctagacgcatccacggcgctggagtacgcacaggcgatgcgtatcatgacgaacctgctgcagtccacgtctcttgtgaccttgtaccaggcgagcgagaacatttacgagaccttcgacaaggtacttgttttgttcgaggggcggcagatctactttggtgatgtgatgagtgctaaggcgtacttcgaggagatggggtacacttgcccaccgagacagtccaccaccgagttcctgacagccctcacagacactaacggttaccatgtggtgaaacccgggcatgaagctacggtgccacgtctgccagaggagttcgaacagtactggttgaattcgaaggagtaccggtctttgctttcggaaattgaggactataggagggaagttgatgctcacgagaccagagatcagttagagaaattcaagttaaagggaaagtcaaagtacacgcacaagcgcagcccgttcatgatttcattctttgagcaggtaaagctatgcaccatcagaggcttccagagaatatacggcgacaagtcatttacagttatcaacgtggtttctgccgtggttcaggctttgatcacaggctctctctacttttccagtccttccaacacctcaggcgccttttcgaggggtggtattctatattatgcgatattgtacttttcattaatgggtctagccaatattaacttttcaaataggccgattttgcagaagcataaaatgtacaccttataccatccaagtgccgaggccctggcttcaacaatttccgcctgtgtgttcagaatgattgctttgactctcttcctaattgttctgtacttcttgtcggggctgactgttgaggcgtggaggttcttcagcatttatctcttcctggtgcttgcctcggagggcatcaatgccatgttcgaagttattactgcgttgtctaccagtttatcacaggcaaacgccgttgcaggtctagttatgtttggtatttccatttattcgacatatatgatccaaaaaccatctatgcatccttggtttgcttggatctcatacatcttacctatacggtatgcattcgagagcatgttgaatgcagaattccatggaagacacatggactgcgcggatacgtatgttccaactggaccaggatatgaaggcgttacccctgagaacagggtatgcgcgtttattggctccaaacctagccagagctgggtgctcggggacgattatctttctgtcaattatgagtatgagtatgaaaaccagtggcgtaatttgggtatcctaatcgctttctggataggatttctcacattgaaatgcctggctactgagtataaacggccaatgaaaggcggaggagattctctggtcttcaagaagggcactctagccaagcgtaaagttcaagatgacagcgaatcccgcaacgtgagcggtgctgcagaatctaaaatggtagcgtccacagtaggtaccgatgatgtttttgatggtttgaagaacgacgatgtcttcatctggagggacattagtttctcaatcactcataatggcgataaaaagaaattattggaccagataaccggatattgtattcctggtacccttactgccctcatgggagaatcaggcgcagggaaaaccacattgctgaataccttggcccagcgtaatgtcggtgtaatcactggagatatgctggtgaacggtttacctattgacgcaagctttgaacgtagaacaggttatgttcaacaacaggatgtccacgttaaagaaatgacggtccgtgagtcgttgcaattttctgcgagattgaggagacccgaatctgtttctgaagcagaaaagatgaattacgtggagaagatcatagaaattcttggcatgtctgactttgctgatgcattggtgggtgatgcagggtatggcttgaatgtggagcaaagaaaaaagttgtctattggtgttgagctagtggcgaaaccatctctgctgttattcttggatgaacctacgtcgggtttagactcacagtcgtcctgggcaattgtacagttgttgaaaagattagcgcagtctggacaagctattttgtgtactattcatcaaccttctgcaactttgtttgagcaatttgatagattacttctcctgcagaagggtggccagaccgtatattttggagatattggtgaagaatctagaactctccttgactacttccagaggaatggtgcacgtccatgtaccccctcagagaatcctgccgagtacatattggaatccattggggcgggtgcaaccgctacaaccacagaagattgggctgagttgtggcgcaattctccagaatgcgcccgcgaaaatgagatcgtcaacaagttggtgaacgaattatccgaaaaatacttgagtaacgcccctgctccaatctcaaaatatgcaaccagctatttctaccagttccgctatgttgtgtctagaaccatgctcatcttctacagagaccttgattatctactctcaaaacagtttctgttcttatccgcaggtctctttattggttttaccttttatgatgttgggacctcttacacggggctgcgcaatacgatgtttgcggtatttatgtctattattacctcagcgccagcaatgaaccagatccaggcgcgtgccattaagatgaaggacctgtacatcgtgcgcgaatccaagtccaacttgttccactggtcactgctactaatcacgcagtatctggccgagttgccataccagtttcttttttctacaatctactttctgtgcatgttcttcccgatgaagctgggactatctgcacgcgaaaacggtatcttcttcctcaacttttgcatagtgttccaagcttactttgttgggcttggccttgctgttctttacttggcaccaaatctcgagtcagctaacgtaattctgggtgtgttcctatcgtttctcatctcgttctgcggcgttgtacagccatactacctaatgcctggcttctggaagttcatgtaccgcctcagcccatatacctacttcacccaaaactttttgggtattatgcttcacgataggccagtcaggtgcaacagtagagaattttcattcttggaccctccaaacggtgttacatgtggtgaatatatgcagccgtttgtcaatagtgtgtccggctatgtggataacccagatgccactagcaattgcgcatactgcatttatcgcgtaggtgacgaatacttagcttctattggcgctaagtacagctatctctggcgcaactttggcatcttatggggctatgttgccttcaacatcattgcgatgttatctctctattggttgttccgcgtcaagaaagttacaatcaaaaaccctttcaaacgtgattga

SEQ ID NO: 114 - protein, 1488 aa, Ashbya gossypii
MLSHHPSTCPDPQRYMIEATGPQWAKTEGHDSRTSLSGSSAPELVAYGSEAGAEERERLSRVMTLQSMGEARAALDPGMAQKVESLARTLSQHTVRDGRLVVDPADFDMKAILSGLVSASQRQDIPMRQTGVLVEGVTVQGVDSSCVEGHDYGDVLALPLTAVRAVRQAMRRRYRNILESVTLLARPGEMVLVLGRPGAGCTSLLKTVAGETDQFHSVEGAISYDGIPQREMMRRYRAEVVYNSEIDVHFPHLTVKQTLDFALACKTPHMRVNNVSRAEYITLMRELYATVFGLRHTYDTKVGNDYIRGVSGGERKRVSIAEALAANASVYCWDNATRGLDASTALEYAQAMRIMTNLLQSTSLVTLYQASENIYETFDKVLVLFEGRQIYFGDVMSAKAYFEEMGYTCPPRQSTTEFLTALTDTNGYHVVKPGHEATVPRLPEEFEQYWLNSKEYRSLLSEIEDYRREVDAHETRDQLEKFKLKGKSKYTHKRSPFMISFFEQVKLCTIRGFQRIYGDKSFTVINVVSAVVQALITGSLYFSSPSNTSGAFSRGGILYYAILYFSLMGLANINFSNRPILQKHKMYTLYHPSAEALASTISACVFRMIALTLFLIVLYFLSGLTVEAWRFFSIYLFLVLASEGINAMFEVITALSTSLSQANAVAGLVMFGISIYSTYMIQKPSMHPWFAWISYILPIRYAFESMLNAEFHGRHMDCADTYVPTGPGYEGVTPENRVCAFIGSKPSQSWVLGDDYLSVNYEYEYENQWRNLGILIAFWIGFLTLKCLATEYKRPMKGGGDSLVFKKGTLAKRKVQDDSESRNVSGAAESKMVASTVGTDDVFDGLKNDDVFIWRDISFSITHNGDKKKLLDQITGYCIPGTLTALMGESGAGKTTLLNTLAQRNVGVITGDMLVNGLPIDASFERRTGYVQQQDVHVKEMTVRESLQFSARLRRPESVSEAEKMNYVEKIIEILGMSDFADALVGDAGYGLNVEQRKKLSIGVELVAKPSLLLFLDEPTSGLDSQSSWAIVQLLKRLAQSGQAILCTIHQPSATLFEQFDRLLLLQKGGQTVYFGDIGEESRTLLDYFQRNGARPCTPSENPAEYILESIGAGATATTTEDWAELWRNSPECARENEIVNKLVNELSEKYLSNAPAPISKYATSYFYQFRYVVSRTMLIFYRDLDYLLSKQFLFLSAGLFIGFTFYDVGTSYTGLRNTMFAVFMSIITSAPAMNQIQARAIKMKDLYIVRESKSNLFHWSLLLITQYLAELPYQFLFSTIYFLCMFFPMKLGLSARENGIFFLNFCIVFQAYFVGLGLAVLYLAPNLESANVILGVFLSFLISFCGVVQPYYLMPGFWKFMYRLSPYTYFTQNFLGIMLHDRPVRCNSREFSFLDPPNGVTCGEYMQPFVNSVSGYVDNPDATSNCAYCIYRVGDEYLASIGAKYSYLWRNFGILWGYVAFNIIAMLSLYWLFRVKKVTIKNPFKRD

SEQ ID NO: 115 - DNA, 4563 bp, Zygosaccharomyces sp.
atgtcgacgccaaaggaagacaaatttgaggataaggattccctttcaaacgtttcgacaccaaatgaagaacactcttatgcagaatcattgcagagctatgaagctcaaggtgcggcagcagaaacacaaggtgatgaggaagagttagctgcaacttcccaaatatcacgtcatttgacgaacatgctttcgaatgaagatggcactgaaagattggcggctatgtcgcgtattatttctacaaagaccaggaaagagatgcaagaatttgaagttaatgatttagatttcgatctaaaatcgctattgaactacttgagatcacattctattgaccaaggcattacaccaaatgattctggtattgcatttaaaaatgtgacagctgttggtatcgatgcttcagccgcttacggtccatctctggaggaaatgctcagagatatggtcaaatggcctgtgaaattttttaagaaattaaccaagagtcaagacgccgtaccattaagaaacattatccaaaattgtactggtgttgtggaatcaggtgaaatgcttttcgtagtcggtagaccaggtgcaggttgttcgacactgttaaaatgtctttcaggtgaaattgctgactatgtccgtgtggaaggttcgttttcctatgacggtcttgatcaaacagagatgatgaagagatataaaggttacgttgtttactgccctgagatggatttccatttcccaaagattactgttaaggaaacgattgactttgcattgaagtgtaaaacgcctcgtgttagagttgataacatgacaaggagccagtacgtcgatagtctgagagacatgtggtgtacagtctttggtttaagacacacctatgccactaaggtcggtaacgaagtggtaagaggtgtttctggtggtgaaaggaagcgtgtttctttggtggaagcacaatgtatgatggcggctttatactcttgggataatgcgacaagaggtttagatgcttctacggcattggagtttgcccaggctattagaactgctaccaatatgatgaacaattctgcgcttgtctgtatttaccaggcaggtgaaaacatttaccgattatttgataaagctaccgttctatacaatggtaagcaaatttactttggtcctgctaacaaagcagttgcttatttccaagatatgggttgggttaaaccacctagaatgacatctgcggaattcttgacatcggtgactgttgatttcgagaatagaacattagacattaaaccagggtatgaggataaagtgccaaaatcgggtgctgagtttgaacagagatggttggagtctgaagaataccaagagttgttaagatactatgatgattatcaagcacgccatccagctgatgaaaccagggatagatttgaaactgcaaagagacaagccttacaaaagggtcaaagaactaaatctcaattcacggttaattactggcatcaagtttggtactgtatgatgcgtggattccaaagagttaaaggtgattctacctataccaaagtctatttatcatccttcactattaaaggtttaattgttggttccatgtttcacaatattgataacaaaagtcaatcaaccactgcaggtgcttattcccgtggtggtttgcttttctatgtcctactgtttgctgctgttacttctttggccgaaattgcaaattcctttgctaatagaccaattgtggttagacataaatcttactcgatgtaccacatttctgctgaatccttacaagaaattatcactgaaatgccaacaaaatgtcttgccatcattattttgggtctaacaacttactggatgccttatatgaaatataccgctggtgccttctttcaatacctgctgtatctatttaccgcccaacaatgtttgtcatttattttcaaatttgtggctactatgacaaaggatggtaccaccgcgcacgctgttggtggtttggcgattttaatgctttgtgtctacactggtttcgtgctaccaattggtgagatgcaccattggattagatggttccactacctcaacccattgtgttatgcttacgagtctttgatgtctactgagttccatgggagacaaatgttgtgttctcagatgataccaagtggaccaggttatgaaaatgtttctgtggctaaccaagtctgtagctccgcaggtgctgttaaaggacataagtatgttagtggtgatgcttatgtgcttaaaagctatcatttcagatatagacatgcttggagaaactggggtattaatgtcgtttggactgctggattcattatgtttaacgttatcctatctgagactttgaaacccctagaaggtggtggtgacttattattgtacaagagaggccacatgcccaactttggtactgaaaatgctgatgccaagaccgccagtagggaggaaatgatggaagctctaaacggtcctggtgttgatttgaaaaaggttattgccgaaaaggatgtcttcacttggaaccatttagattacgttattccatatgatggtgctaccagacaattgttgtgcaacgtttttggttacgttcaacccggaaaaatgactgccttgatgggtgagtctggtgccggtaagacgactttgttaaatgttttggcccaaagagtcaacatgggtacagtgactggtgatatgttagttaacgctaagccattaccacaatctttcaataggtcctgtggttatgttgcacaagctgataaccacatggcggaattaagtgttagggaatccctaagatttgctgctgttttaagacaacctgcttctgttccaattgctgaaaaatatgactatgtggagaagattctgctattattgggtatgcaaaactatgctgaagcgtatgtgggtaaaaccggtaggggtttgaatgttgagcagagaaagaaattgtctattggtgttgagttggttgctagaccagctctgttattgtttttagatgaacctacttctggtttggactctcaatctgcttggtctatcgttcaattcatgagggcattggctgattctggtcaatcgattttgtgtacgattcaccagccttctgctactctgtttgagcaattcgacagattgttgttgttaaagaaaggtggtagaactgtgtactttggtgacattggaccaaactcttctacgatgttgagttactttgagcgtgaatcaggtgtcaagtgtggtgtttctgaaaatcctgcagagtacattttgaactgtattggtgctggtgccactgcatctacgagtgctgattggggtgacctgtgggaaaagtcaccagaatgtgctaaagcgagggaagaagtcgaggaattacatcgcacgctacctagtaaaccaaccaatgaggatcctgaactatgtaccaaatttgctgcaacttatcctgttcaattgaaaatggttttgttaagaacattaattcaattttggagatcacctgtctatcttagagcaaagttttttgaatgtgttgcttgtgctcttttcgttggtttgtcttatgtgcatgtgaaccactcattaggtggcgctcaagaagccttttcttctattttcatgttgttgttggttgctttagcaatgatcaaccaattgcacgttttcgcctatggttctagagaattgtatgaagtcagagaggcggcttccaatactttccactggtctgctcttttattgatgcacacaaccgtggaacttatgtggtccactatgtgtcaattcttctgtttcatctgttactactggcctgctaatttcaatggtcgtgcatctcacgctggtttctttttcttcttctatgttttgattttcccacttttcttcgtcacttatggtctatggattctttacatgtctccagatgtgccatctgcatccatgatcaactccaacctgtttgctggtatgttactgttctgtggtatcttacaaccaagagagaagatgcctgcattctggagaagattgatgtacaatacctctccgtttacttatgttgtacaagcattggttgcaccattggtgcacaataagaaggttgtctgtaatgagggtgattatctcaggatggatccaccttccggtcaaaactgtggtgtttatttgaaaccttttatgtcactccatggtggttacttggttaatccagatgctggcaatgagtgtaaatactgtccttacaccgttcaagaccaagttgtggccagattcaatgttcgttgggataagagatggagaaattttgggtttatgtgggcttacatcattttcaatgtctttgccatgttggtatgttactacatcatgagagttaaggtgtggtctttaggtagcttgttaaatgtgaagagttggatccctaagaagaaggatagacacgagaaggataccactatctttcaaacgaagcctggcgatgagaatatggttaaaaaacagtaa

SEQ ID NO: 116 - protein, 1520 aa, Zygosaccharomyces sp.
MSTPKEDKFEDKDSLSNVSTPNEEHSYAESLQSYEAQGAAAETQGDEEELAATSQISRHLTNMLSNEDGTERLAAMSRIISTKTRKEMQEFEVNDLDFDLKSLLNYLRSHSIDQGITPNDSGIAFKNVTAVGIDASAAYGPSLEEMLRDMVKWPVKFFKKLTKSQDAVPLRNIIQNCTGVVESGEMLFVVGRPGAGCSTLLKCLSGEIADYVRVEGSFSYDGLDQTEMMKRYKGYVVYCPEMDFHFPKITVKETIDFALKCKTPRVRVDNMTRSQYVDSLRDMWCTVFGLRHTYATKVGNEVVRGVSGGERKRVSLVEAQCMMAALYSWDNATRGLDASTALEFAQAIRTATNMMNNSALVCIYQAGENIYRLFDKATVLYNGKQIYFGPANKAVAYFQDMGWVKPPRMTSAEFLTSVTVDFENRTLDIKPGYEDKVPKSGAEFEQRWLESEEYQELLRYYDDYQARHPADETRDRFETAKRQALQKGQRTKSQFTVNYWHQVWYCMMRGFQRVKGDSTYTKVYLSSFTIKGLIVGSMFHNIDNKSQSTTAGAYSRGGLLFYVLLFAAVTSLAEIANSFANRPIVVRHKSYSMYHISAESLQEIITEMPTKCLAIIILGLTTYWMPYMKYTAGAFFQYLLYLFTAQQCLSFIFKFVATMTKDGTTAHAVGGLAILMLCVYTGFVLPIGEMHHWIRWFHYLNPLCYAYESLMSTEFHGRQMLCSQMIPSGPGYENVSVANQVCSSAGAVKGHKYVSGDAYVLKSYHFRYRHAWRNWGINVVWTAGFIMFNVILSETLKPLEGGGDLLLYKRGHMPNFGTENADAKTASREEMMEALNGPGVDLKKVIAEKDVFTWNHLDYVIPYDGATRQLLCNVFGYVQPGKMTALMGESGAGKTTLLNVLAQRVNMGTVTGDMLVNAKPLPQSFNRSCGYVAQADNHMAELSVRESLRFAAVLRQPASVPIAEKYDYVEKILLLLGMQNYAEAYVGKTGRGLNVEQRKKLSIGVELVARPALLLFLDEPTSGLDSQSAWSIVQFMRALADSGQSILCTIHQPSATLFEQFDRLLLLKKGGRTVYFGDIGPNSSTMLSYFERESGVKCGVSENPAEYILNCIGAGATASTSADWGDLWEKSPECAKAREEVEELHRTLPSKPTNEDPELCTKFAATYPVQLKMVLLRTLIQFWRSPVYLRAKFFECVACALFVGLSYVHVNHSLGGAQEAFSSIFMLLLVALAMINQLHVFAYGSRELYEVREAASNTFHWSALLLMHTTVELMWSTMCQFFCFICYYWPANFNGRASHAGFFFFFYVLIFPLFFVTYGLWILYMSPDVPSASMINSNLFAGMLLFCGILQPREKMPAFWRRLMYNTSPFTYVVQALVAPLVHNKKVVCNEGDYLRMDPPSGQNCGVYLKPFMSLHGGYLVNPDAGNECKYCPYTVQDQVVARFNVRWDKRWRNFGFMWAYIIFNVFAMLVCYYIMRVKVWSLGSLLNVKSWIPKKKDRHEKDTTIFQTKPGDENMVKKQ

SEQ ID NO: 117 - DNA, 4389 bp, Zygosaccharomyces rouxii
atggaatttgaacctaaaagtgagggcagtttgcccagttatgaggggttagacaaaagcgctgaagtccaagttcaacgattagctcatggtgttaaccctattcatgaaggtgctcctcagctagatccgaattcttcggatttttcgagtaaggcatggattcaaaatatggcgaatttgagttcggaggatcctgatcattttaagccatatcaggtcggatgttgttggaaagaccttgccgctagtggtgcctcggcagatgtcgcttatcagactactgtggaaaatttaccatggaaggtgcttttctggatttatagaaaattgaggccaacgaggaaatctgacattttccagattttaaaacccatggacggtgcattagatcctggtgaagtgttggttgtcttaggtagacctggttcagggtgcacgactttattaaaatctattgcatctaatacccacggttttaatattgcaaaggattctacgatttcatacagtggactttctcctaaggatattaataggcattttagaggtgaagtggtttacaatgcagagacagatattcatctaccgcatctaacagtatatcaaacgttactcactgtttcgaggttaaagactccacagaatagaattaaaggtgtggatagagagacgtgggccaggcacatgaccgacgttgttatggcaacctacgggctgtcacatacgaaaaataccaaggtcggtggtgatctagttagaggtgtttctggtggtgaaagaaagcgtgtctccatcgcagaagtgacgatctgtggatccaagttccaatgttgggataatgctactagagggttggatgcggcaactgctctagaattcatcaaggcattaaggacgcaggcggatattttggcaagtacagcatgtattgccatttaccaatgttctcaaaatgcatacgacttgttcgataaggtgtgtgttttgtacagtggttaccagatcttttttggatctgcaggagatgctaaacgctatttcgaggaaatggggtatcattgtcctagtagacaaaccactgcggatttcttaacatcagttacaagtcctgcggagagaactgttaataatgaatatattgaaaagggtatacatgtgcctgaaacacccgaagagatgtcagattattggagaaactctcaagagtatagagatttgcaagaacaaattcaaaacagactggatcagaatcacgaagagggcctaagagccattaaggaatcccataatgccgcgcaatcaaagaggacccgtcgatcttcaccttataccgttagttatgggatgcaaattaagtatttactgattaggaacatgtggagaattaaaaacagttcaggtattactattttccaagtgtttggtaattctgttatggctcttttgttaggttccatgttttacaaagttttgaagccttcatctacggacactttctattacagaggtgcagccatgttttttgccattcttttcaatgccttttcatctctactggaaattttctcactgtatgaagctagaccaattactgagaagcatagaacttattctctttaccgcccaagtgcagatgcatttgcatctgtcctttctgaaattccaccaaagatcgtaactgcaatttgtttcaatgtcgcactctacttcttagtgcattttagagtggatgctggtagatttttcttctattttctcattaacattttggccatattttccatgtctcatatgtttagatgtgtcggttcactaactaaaactttgacagaagcaatggttccggcttctatcttacttttggtgttatccatgtataccggttttgctattcctaagacaaagatgctaggttggtctaaatggatttggtacatcaatccattgtcataccttttcgaagcgctaatggttaacgaatttcacgatcgtaactttagttgtacttcatttattcccatggggccaggttatcaatctgtgtcaggtacacaaagggtatgtgccgctgtgggggcagaacctggtcaagattatgtacttggtgataactatatcaaacagagttatggctatgaaaataaacataagtggcgtgcgtttggagttggtatggcatatgtgattttctttttctttgtctatttgttcctatgtgaagttaatcaaggtgctaaacaaaatggtgaaatcctagtatttccacaatcagtggttaggaagatgcgtaaacaaaagaaaatcagtgccggtagtaacgattccagtgatccggaaaaaacaattggtgtcaaggttaacgatttaaccgatacgactttgattaagaattccacggactcttcagctgaacaaaatcaagatattggattgaataaatctgaggccattttccattggagaaatgtatgttatgatgtgcaaatcaaaagcgaaacaaggcgtatattggacaacattgatggttgggttaaaccaggtacgttgactgcccttatgggtgctactggtgctggtaaaactacgcttcttgattccctagcacaaagagttactacaggtgttttaactggtagtattttcgtcgatggtaaattgcgtgatgaatctttcgcaagatctattggttattgtcagcaacaagatctgcacttgactactgcaaccgttagagaatctttattgttttcagctatgttacgccaacctaagagtgttcctgcttctgaaaagagaaagtatgtggaggaagtcattaacgttcttgaaatggaaccttatgcagatgccattgttggtgtagctggtgagggattgaacgtggaacagaggaaaaggttgaccattggtgttgagttggcggctaaacctaatcttctgcttttcctcgatgaacctacatcaggtttggattctcaaacggcatggtctatctgccaactgatgaagaagttagctaatcgtggacaggctatcctgtgtacaattcaccagccttctgccatgttgattcaagaatttgacagattgttattcttacaaaaaggtggtcaaactgtctattttggtgatttgggtaaagactgtaaaagcatgattcattattttgaaagccatggttcccataaatgtccgtctgacgggaatccagcggaatggatgcttgaaatagtgggtgctgcacctggaacacatgcgaatcaagattactatgaagtctggagaaattctgaagagtatcaagaagtgcagaaagaattggatcgcatggaagacgaattgaaaggtatagatggtggagatgaaccagagaagcataggtcatttgctactgatatttttacacaaattagactcgtcagtcatcgtttattacagcaatactggagaagtccttcttacttattcccaaagtttttattgaccgtcttcagtgaacttttcattggttttactcttttcaaggcagataggtcattacaaggtttacaaaatcagatgttatcggtattcatgtacacagttgtcttcaacactttgttacagcagtacctaccactttatgtgcaacagagaaatctatatgaagctagagaaagaccttcaagaactttttcatggtttgcattcattgtttcacaaattttcatagaagtgccttggaatatcttggctggaaccgttgcatttttctgttattactaccccattggattttaccgtaatgcatccgagtctcatcaattgcatgaaagaggagctctgttttggttattctctaccgcatactacgtctggattggatcaatgggtctgttggctaattcctttatcgaacacgatgtggctgccgccaacttggcaagtttgtgttacactctagctctatccttctgtggtgttctggctacaccaaaggttatgcctcgtttctggattttcatgtacagagtttctccgttaacctatttcattgatgcgactttggcgactgggattgccaatgtagatgtcaaatgtgcagattatgaattcgccaaatttacaccgccaaaagggcaaaactgtggtgattacatgaagaactttattaaatcagcaggtactggttatttgaaagattcctcagccgttgatgaatgtaatttttgtcaattttccaccactaacgcttacttggaatctgttacatcctcttactctcgcaggtggagaaactatggtatctttatctgctttatcgcttttgattacatcgctgctgtcttcctttactggcttgctagagtgcctaagaagagcggtaaagtctcggggaagaaatga

SEQ ID NO: 118 - protein, 1462 aa, Zygosaccharomyces rouxii
MEFEPKSEGSLPSYEGLDKSAEVQVQRLAHGVNPIHEGAPQLDPNSSDFSSKAWIQNMANLSSEDPDHFKPYQVGCCWKDLAASGASADVAYQTTVENLPWKVLFWIYRKLRPTRKSDIFQILKPMDGALDPGEVLVVLGRPGSGCTTLLKSIASNTHGFNIAKDSTISYSGLSPKDINRHFRGEVVYNAETDIHLPHLTVYQTLLTVSRLKTPQNRIKGVDRETWARHMTDVVMATYGLSHTKNTKVGGDLVRGVSGGERKRVSIAEVTICGSKFQCWDNATRGLDAATALEFIKALRTQADILASTACIAIYQCSQNAYDLFDKVCVLYSGYQIFFGSAGDAKRYFEEMGYHCPSRQTTADFLTSVTSPAERTVNNEYIEKGIHVPETPEEMSDYWRNSQEYRDLQEQIQNRLDQNHEEGLRAIKESHNAAQSKRTRRSSPYTVSYGMQIKYLLIRNMWRIKNSSGITIFQVFGNSVMALLLGSMFYKVLKPSSTDTFYYRGAAMFFAILFNAFSSLLEIFSLYEARPITEKHRTYSLYRPSADAFASVLSEIPPKIVTAICFNVALYFLVHFRVDAGRFFFYFLINILAIFSMSHMFRCVGSLTKTLTEAMVPASILLLVLSMYTGFAIPKTKMLGWSKWIWYINPLSYLFEALMVNEFHDRNFSCTSFIPMGPGYQSVSGTQRVCAAVGAEPGQDYVLGDNYIKQSYGYENKHKWRAFGVGMAYVIFFFFVYLFLCEVNQGAKQNGEILVFPQSVVRKMRKQKKISAGSNDSSDPEKTIGVKVNDLTDTTLIKNSTDSSAEQNQDIGLNKSEAIFHWRNVCYDVQIKSETRRILDNIDGWVKPGTLTALMGATGAGKTTLLDSLAQRVTTGVLTGSIFVDGKLRDESFARSIGYCQQQDLHLTTATVRESLLFSAMLRQPKSVPASEKRKYVEEVINVLEMEPYADAIVGVAGEGLNVEQRKRLTIGVELAAKPNLLLFLDEPTSGLDSQTAWSICQLMKKLANRGQAILCTIHQPSAMLIQEFDRLLFLQKGGQTVYFGDLGKDCKSMIHYFESHGSHKCPSDGNPAEWMLEIVGAAPGTHANQDYYEVWRNSEEYQEVQKELDRMEDELKGIDGGDEPEKHRSFATDIFTQIRLVSHRLLQQYWRSPSYLFPKFLLTVFSELFIGFTLFKADRSLQGLQNQMLSVFMYTVVFNTLLQQYLPLYVQQRNLYEARERPSRTFSWFAFIVSQIFIEVPWNILAGTVAFFCYYYPIGFYRNASESHQLHERGALFWLFSTAYYVWIGSMGLLANSFIEHDVAAANLASLCYTLALSFCGVLATPKVMPRFWIFMYRVSPLTYFIDATLATGIANVDVKCADYEFAKFTPPKGQNCGDYMKNFIKSAGTGYLKDSSAVDECNFCQFSTTNAYLESVTSSYSRRWRNYGIFICFIAFDYIAAVFLYWLARVPKKSGKVSGKK

SEQ ID NO: 119 - DNA, 4524 bp, Kluyveromyces polyspora
atggctgacaatatttcagaaataaatgaaaagttaggagatttaaacaattcaagagctaataataatggtgcaactaatgatgaaagcgaggaaactctagaacctgaacatattttagagaattttgataatacaggacgttcttttgccaaagattcgagaccttcatcaatttcagaacatgaaagtacagaatcattgactaacagccgactggttaatagaattacttctttggcaagaaccttttctcatgtagagacctccagcagtgaagctgactttgaaacaattaaagaccctagaaagataatagaaaaatttgtgagagatgcttttgaacaaggtattcatatcagaaacactagtataataatggaagatattaccgttcaagttcccgatacatcaagacaagaagccagtacatttggcgatttcattttattgccaattacaatttacaagatgattaaaaaattcacacaacataagaagatgaaatcaattttaagtgaagtaaacttcttggtaaaaccaggaaatatggttttggttttaggaagacctggatcaggctgttcaactttgttgaaaactgcagtaggcgaaactagttcatataaaggtaacgtatcaggatctgttacatatgatggtattcctcaaaaagaaatggttaaaaattataaatcagacttaatatactgtgctgaaactgacattcatttcccacatttaactgttaaacaaactttagattttgccctggcttgcaaagttcaaaacgttagaataaataatatgtcagcaaagaaacaaattggcattgcaagagatttattggcaactatatttggtttacgtcacacttactctacaaaagttggcaatgattttgttagaggtgtttccggaggtgaaagaaagcgtgtttctattgctgaagcattggctgccagaggtaccatttatgcttgggataatgctacaagaggattagatgcgtctacagcactggaatttgcccaggctcttcgaacatttacagaattattaaaatcaacctctttctgttgtttgtaccaagtcagtgagaatatattccacacatttgatatggtgacagtgctttattcaggaaaacaaatctattatggccctgtcgctaaggctaaggacttctttgaacgaatgggatacaaatgtccaccaagacaagacacagcagagtttttaactgcattaacagatcctaatgggctccatctcattaaagaaggttttgaaggaactgtaccaaggagcgctgacgagtttgagtcgtattggaagagttcacctgagtttaaacagttgttgtcagatatcgaaacttataagacagaagtagacccagagaagacgagagaaatctacacaatgtccttaaagcaggaaaagacaaaatggacaagaaagagttcttattatactgtatcatttccagaacaagttaaattatgtactattagaggatttcaaagaatatatggtgacaagagtttttccatcattagcactgtagctgctgtttttcaatcattcattattggatctctattttataacacaccgtcatcgacatctggtgcgttttctagaggtggtacccatttctttatgctattatactattccttgatcagtttagccaatatttcatttgcacagagaccaattattaataagcataaaagctattctttttaccatccagctgcggaagcactctcagagaatctttcattctttccattcagaatgataggtttaactatgtttatggtggtaatatatttcttggcaggattgagaagaacggctagtgcattcttcataacttatttatttcttactatggctgcggaaattatcaattgtctatttcagatgattgcagctgcttgtgaaactataaatgaagccaactctataaatgggatattaatgctgtcattgtcaatgtactcgacgtatatgatccaattaccagaaatgcgtgtatattttaaatggatatcatttgcattaccattaaggtatgggtttgagtcaatgttaaacgctgaatttcacaatagatatatgagctgtggtggcacactagtcccatctggtccaggatatgagaatgtccctccctcaaatcaggtttgcgcattccctggctctacacctggatcatccgaagttcttggtgataattatttgagggtccaatttacttaccaatataagaacacatggagaaattttggtattttttggtgttttttgttaggttatcttgggttaaagtgtcttctagctgaattcaaaccgtcatttaggaaagaaggcaatattttgttatataaaaagaattccaaaatactttctccatttaaagatgaggaatcaactcctgatgtaggtgaagtgagtttgaaacatcacacgactgcaacctcttcaaataatgaaactatagtacatgaaaaggatgaagtattcgaaggcttgggaagtactggaaacttcctttggagagatcttgtttatacgatcccacttgagggcagtaccagagttttattggatcatgtttcaggatattgtatcccaggaaaactgactgctttaatgggtgaatctggagctgggaagactactctattaaacactttagcacaaaggaatgaaataggtgttgtgacaggagatataaaagttgatggtgccaaaattgatattagttttgggagacgtaccggttatgttcaacaacaagatgtccatttagcagaattgactgtaagagaagctttaatattctctgctatgatgcgtcgtcctgaatcagttccttatagtgagaaattggactttgttgaaaagataatcgaggttttagagatgggagactatgctgacgctttggttggcttagagggtagtggcttaaatgtcgaacaaagaaaaaaattgtcaattggtgttgaactagttgccaggcctgatattttattgtttgtagatgaacctacctctgggctagactcccaagaagcatggtcaattgtccaattattgaaaaggttatcagagtctggacagtccatcttatgtaccattcatcaaccttctgcaacactatttgaacaatttgataggttgttacttttgaaaaaaggtggtaaaacagtatattttggagatattggtaataattctgatactgtcctagattattttgagaggaatggtggaaggaaatgtctcgaaagtgaaaacccagctgaatacattttggaaataattggggctggtgcctctgcttctgtagaagaagactggggttcagtttggaataactcacctgaatctacaactgttcaaaatgatatcgaaggattactaagtgaaaagggcaataggcctgatggtgagcactccattaataaaacatatgccacttcatacttttatcaatttaaatgtgtccagatgagagcatttacaattctatggagagatactaattatttagtatcgaaatttatgcttttcttagttactggattatatattggttttacattcttccatgtcccccaatcttataatggtttacaaggtgctctgtttgcagcatttttgacactgattacttcagcaccagtaatgaatcaaatacaagctagggcaatagaggcaagagaattatatgaagttcgtgaatctaagtcaaatgtattccattggtctttattacttctttgccaatatttcagtgaaattccatatagtcttgtattttctgccatttattttgtaagtttctacttccctgttggtatattttacgaagcgtctcgatcagcagtattttacttaaactatggagttatgttccaattcttttacgttgccctgggattaatggttttatacctgtcgccaaatttacaatcagcaaacgtgatcatgggtctgactttatctttccttgtagcattttgcggtgttgtacagccaaagactttaatgccaggtttctggacattcatgtggaaagcatcaccttacacatatttcgttcaaaatttaatttcaatcatgttgcatgataagcctgttgtttgtaaagagaaggagctttcgtttcttgatcctcctacaggtttaacttgtggagaatacatggcaccatttctcacaatagctccaggatacataaacaatcctgatagcacatctaattgcggatattgtctctattcagtaggtgacagctatttagagagagtgtcagcaagttatagtaatctatggagaaattttggattttattgggcatacattgtatttaacctaatagcaatggtagtaagttactacattttccatattttaaaaattccttccaagataatacatataattaaaaatgcacttgcagcatttagaatcaaacaaaagaataaaaataacaattga

SEQ ID NO: 120 - protein, 1507 aa, Kluyveromyces polyspora
MADNISEINEKLGDLNNSRANNNGATNDESEETLEPEHILENFDNTGRSFAKDSRPSSISEHESTESLTNSRLVNRITSLARTFSHVETSSSEADFETIKDPRKIIEKFVRDAFEQGIHIRNTSIIMEDITVQVPDTSRQEASTFGDFILLPITIYKMIKKFTQHKKMKSILSEVNFLVKPGNMVLVLGRPGSGCSTLLKTAVGETSSYKGNVSGSVTYDGIPQKEMVKNYKSDLIYCAETDIHFPHLTVKQTLDFALACKVQNVRINNMSAKKQIGIARDLLATIFGLRHTYSTKVGNDFVRGVSGGERKRVSIAEALAARGTIYAWDNATRGLDASTALEFAQALRTFTELLKSTSFCCLYQVSENIFHTFDMVTVLYSGKQIYYGPVAKAKDFFERMGYKCPPRQDTAEFLTALTDPNGLHLIKEGFEGTVPRSADEFESYWKSSPEFKQLLSDIETYKTEVDPEKTREIYTMSLKQEKTKWTRKSSYYTVSFPEQVKLCTIRGFQRIYGDKSFSIISTVAAVFQSFIIGSLFYNTPSSTSGAFSRGGTHFFMLLYYSLISLANISFAQRPIINKHKSYSFYHPAAEALSENLSFFPFRMIGLTMFMVVIYFLAGLRRTASAFFITYLFLTMAAEIINCLFQMIAAACETINEANSINGILMLSLSMYSTYMIQLPEMRVYFKWISFALPLRYGFESMLNAEFHNRYMSCGGTLVPSGPGYENVPPSNQVCAFPGSTPGSSEVLGDNYLRVQFTYQYKNTWRNFGIFWCFLLGYLGLKCLLAEFKPSFRKEGNILLYKKNSKILSPFKDEESTPDVGEVSLKHHTTATSSNNETIVHEKDEVFEGLGSTGNFLWRDLVYTIPLEGSTRVLLDHVSGYCIPGKLTALMGESGAGKTTLLNTLAQRNEIGVVTGDIKVDGAKIDISFGRRTGYVQQQDVHLAELTVREALIFSAMMRRPESVPYSEKLDFVEKIIEVLEMGDYADALVGLEGSGLNVEQRKKLSIGVELVARPDILLFVDEPTSGLDSQEAWSIVQLLKRLSESGQSILCTIHQPSATLFEQFDRLLLLKKGGKTVYFGDIGNNSDTVLDYFERNGGRKCLESENPAEYILEIIGAGASASVEEDWGSVWNNSPESTTVQNDIEGLLSEKGNRPDGEHSINKTYATSYFYQFKCVQMRAFTILWRDTNYLVSKFMLFLVTGLYIGFTFFHVPQSYNGLQGALFAAFLTLITSAPVMNQIQARAIEARELYEVRESKSNVFHWSLLLLCQYFSEIPYSLVFSAIYFVSFYFPVGIFYEASRSAVFYLNYGVMFQFFYVALGLMVLYLSPNLQSANVIMGLTLSFLVAFCGVVQPKTLMPGFWTFMWKASPYTYFVQNLISIMLHDKPVVCKEKELSFLDPPTGLTCGEYMAPFLTIAPGYINNPDSTSNCGYCLYSVGDSYLERVSASYSNLWRNFGFYWAYIVFNLIAMVVSYYIFHILKIPSKIIHIIKNALAAFRIKQKNKNNN

SEQ ID NO: 121 - DNA, 4470 bp, Kluyveromyces waltii
atgagtggtgaagcgcagctcaactccagccgcaggtcgttcacggacgaagaagaggaagcggagaaaaggtattttgggccagaaggcgaaccagaatttaaggatgcgccaggtggcgatggccagtcagcgcaggcccacatcacacggttaacggcacgcaggacgaattcgggtcttcaggatctagatgccgagtcgatatcgcggatacatacactcgctcgcacgttgtcgaactaccagataccaggcaacgcgctagaggtggatccagacaactttgacgcagaggccattattcgggcgcacgtacggggcagtgaaagccagggcatccatttgcgtaaggcaggggttattgccgagaactttacagtggtaggaaaggattgctcgtctgcggaagcgcagacattcgaagacattctactgctgcccagaacgattttccggggcgtgcgggaggtcaaaaaccgcgggaacagagatattgtgcgcaatgcgagcctactagcgcgcccaggagacatggtactggtactaggacgtccaggggccggttgctcgtcatttttgaagaccatcgcgggtgagacacgcaatttcgaagaagtgcgtggttcaatctcttatgatggcattccacaggaagaaatgatgaagaagtacaagacagacgtaatttacaatggtgagatggacgtgcactttccacatctgactgtccaacagactttggatttcgcgctatcgtgtaccacgccacgagtacggctagacggtgcatcacggtccgagtatatcactgccatgcgtgagctttacggtaccatcttcgggctgcgccatacttacaatacaaaggtgggcaatgatttcgtgcgcggtgtgtcaggtggagagcgtaaacgtgtttccatcgcagaggctctcgcggcgcgtggctccatctactgttgggacaatgccacgcgtggtctcgatgcctcaacagctctagaatttgcgcaggccattaggaccatgaccaacctgcaaaaatctatcgcgctcgtaaccatttaccaggcgagcgaaaacatctacgagtgtttcgacaaagtcacagtactttatgatggccggcaaattttctttggtgccattgagcaggctaaggcatattttgagaaactggggtaccgctgtcccgcaagacaagcttctgccgaatttctaacggctctaactgaccctcaaggtctgcatgagtacgttcctggattcgacgatagagtgccaagaaccgccgacgagtttgagaaatgctggctagagtcggctgaataccaacgtctcttggcagacatcgaagactacaaacaggagactgaggccgagaagaccaaagccatgtatgacaagtcgttagcgcaagagaaatcgaaacttaactccaaaaggtcaaaatataccctttcgttcgtggagcaagtgagattatgtaccattcgtggtttccaaagaatttatggtgataaagcttatacaattacgaacaccatcgcggcaacgatccaaggtcttgtaagtggttccctctactacaatctaccatcgggggtatctggagcattttccagaggtggtgtcttctactttgcgatcttgtacgcttcccttatgggacttgccaagattaacctggatggtagaccagtgatgttgaagcatcggtcctactccctgtaccatcccgcagcggatgcccttgctggctcgatatctgagtttccgttcagatttattagtcaaacgctctttttcatcatcatttacttccttgcaggccttacaagagaggccaaccgtttcttcattgcgttcctgttcttagtcatgtgctcagagtctgtgaatgctttgttcgacttgatcaccgcttttagctcctccgttgctcaagcaaattcgattgcgggaactgttttaatggcgttgatcttgtattctacctatatgattcaattgggttccatgcacccatggtttaagtggatttcctacgtccaacctttgcgttactctttcgaaagtatgcttaatgctgaatttcatgcgagagaaatggactgcaaggggaacgtcattccatatgggccatcatatgcaaacgtgtctaccgaaaatcaagtgtgtgcttttgtgggctcacgcccagggcaaccttttgtgactggagatgattatatcaataccaattacgggtacaagtatagtcatacttggagaaacctcggttttatgtttgccttctttttgttttacttatctctcaagtgcatcatcactgagtttaaacattcctcggttggcacaggtgacacattagttttcaagaaaggtgccaaaagagtagtttctccatctgacgaagaaagcagagataagtccataacaatgtccgaggccaagagaaatgctgacagcagtgcctcttgcagcagtaactccgacgcgctacaagctatgaaaagtactggcgtttttgtctggaaggaagtcaacttcacgatcccttacaagggctcaactcgtaaacttcttgacaatgttagcggatattgcgcaccaggttcccttactgctctgatgggcgaatcaggagccggtaagacgactttactgaatactttggcccaaagaaatgtgggaattatcactggtgacatgttggtgaacggcaaacccatcgatgccagctttgaaagacgtacgggttacgtccagcagcaagatgtgcatgtgaaggaaatgacagtacgtgagtctttccagttcgctgcaagaatgcgtaggcctcaatccatacctgaatctgagaaacttgcctatgtcgaaaagatcattgagatcttagatatggaagattatgctgaggcgcttatcggtgacgtgggttacggtctgaatgttgaacaaaggaagaaggtttctatcggagttgaattggcagctaagccagatctcttgcttttcttggacgagccaacttccggtctggattcgcaatcttcttgggcaattgttcagttgatgcggagattagcagaggctggccaatctatcctttgtactatccaccagccttcagctacgctttttgaagagttcgataggcttttgcttctaaagaaaggaggccagaccgtgtactttggacctatcggtaagaattcccgtatgttacttgactacttcgaagaaaacggggcaagaaagtgtgagaagactgagaaccccgctgaatacatattagaggctattggtgcaggtgccactgcgtccgttaaagaggactggcacgatatctggaaaaagtcttcgcaatttaagatcgctaatgaagagattgataattacgttagagattcatcaggaagctcgggtaccgagggcgatagggtaagcaaatacgcgacatcatactcataccaattcagatatgtgttgcaaagaaccgcaaccattttttggagagatgtgaactaccttatggccaaaatgatgctttacatcagtactggtttgttcatcggtttcacattttataatgttggcacctcctatcatgggttgcagaatgcaatgttcgctgctttcatggccttaattgtatcggctccggcaatgaatcagattcaggcccgtgccatttcatctcgtgaattatttgaagtcagagagtccaaatctaacacctttcattgggctttcctcctcgttacccagtacttgtgcgagatcccatatcacttcgtgttttcgactatgtttttcgttgccttctacttccccctcagagttcactttgaagcgtcatactcggccgtgtttttcctaaactactgcattatgttccaactttatatcgtgggacttggtttgatgctgatttacgccgcaccagatttgccctctgctggtgttctactaagtttgtgcttgtctttcttgatatccttttgcggtgttattcagccggcatcgctgatgccaggattttggacttttatgtggaaggcttccccttatacatattttgttcaaaatgctgttagcattgttctcaacaacaagcctgtacgctgtaggaagaaggaaatgtcatatctgaatccacccgaaggtcaaacatgcggcgaatacatggctgacttcctgaaatcagctcccggctacatcaataatccagatgcaacagaaaattgcggttactgtgttttcaaggttggcgatgactacttaaaacaaattgatacgagttttggtaatatctggagaaattttgggttcttttgggtctacatttttttcaacgtatttgcaatgttagtcttgtactacgtcttccacgttagcaacttctctttgaaggagacaagaatcgtgaagaaattaatgggcaaaatacgcaaggaatag

SEQ ID NO: 122 - protein, 1489 aa, Kluyveromyces waltii
MSGEAQLNSSRRSFTDEEEEAEKRYFGPEGEPEFKDAPGGDGQSAQAHITRLTARRTNSGLQDLDAESISRIHTLARTLSNYQIPGNALEVDPDNFDAEAIIRAHVRGSESQGIHLRKAGVIAENFTVVGKDCSSAEAQTFEDILLLPRTIFRGVREVKNRGNRDIVRNASLLARPGDMVLVLGRPGAGCSSFLKTIAGETRNFEEVRGSISYDGIPQEEMMKKYKTDVIYNGEMDVHFPHLTVQQTLDFALSCTTPRVRLDGASRSEYITAMRELYGTIFGLRHTYNTKVGNDFVRGVSGGERKRVSIAEALAARGSIYCWDNATRGLDASTALEFAQAIRTMTNLQKSIALVTIYQASENIYECFDKVTVLYDGRQIFFGAIEQAKAYFEKLGYRCPARQASAEFLTALTDPQGLHEYVPGFDDRVPRTADEFEKCWLESAEYQRLLADIEDYKQETEAEKTKAMYDKSLAQEKSKLNSKRSKYTLSFVEQVRLCTIRGFQRIYGDKAYTITNTIAATIQGLVSGSLYYNLPSGVSGAFSRGGVFYFAILYASLMGLAKINLDGRPVMLKHRSYSLYHPAADALAGSISEFPFRFISQTLFFIIIYFLAGLTREANRFFIAFLFLVMCSESVNALFDLITAFSSSVAQANSIAGTVLMALILYSTYMIQLGSMHPWFKWISYVQPLRYSFESMLNAEFHAREMDCKGNVIPYGPSYANVSTENQVCAFVGSRPGQPFVTGDDYINTNYGYKYSHTWRNLGFMFAFFLFYLSLKCIITEFKHSSVGTGDTLVFKKGAKRVVSPSDEESRDKSITMSEAKRNADSSASCSSNSDALQAMKSTGVFVWKEVNFTIPYKGSTRKLLDNVSGYCAPGSLTALMGESGAGKTTLLNTLAQRNVGIITGDMLVNGKPIDASFERRTGYVQQQDVHVKEMTVRESFQFAARMRRPQSIPESEKLAYVEKIIEILDMEDYAEALIGDVGYGLNVEQRKKVSIGVELAAKPDLLLFLDEPTSGLDSQSSWAIVQLMRRLAEAGQSILCTIHQPSATLFEEFDRLLLLKKGGQTVYFGPIGKNSRMLLDYFEENGARKCEKTENPAEYILEAIGAGATASVKEDWHDIWKKSSQFKIANEEIDNYVRDSSGSSGTEGDRVSKYATSYSYQFRYVLQRTATIFWRDVNYLMAKMMLYISTGLFIGFTFYNVGTSYHGLQNAMFAAFMALIVSAPAMNQIQARAISSRELFEVRESKSNTFHWAFLLVTQYLCEIPYHFVFSTMFFVAFYFPLRVHFEASYSAVFFLNYCIMFQLYIVGLGLMLIYAAPDLPSAGVLLSLCLSFLISFCGVIQPASLMPGFWTFMWKASPYTYFVQNAVSIVLNNKPVRCRKKEMSYLNPPEGQTCGEYMADFLKSAPGYINNPDATENCGYCVFKVGDDYLKQIDTSFGNIWRNFGFFWVYIFFNVFAMLVLYYVFHVSNFSLKETRIVKKLMGKIRKE

SEQ ID NO: 123 - DNA, 4683 bp, Kluyveromyces lactis
atgtcggacgactcagggtcctcaattgacgaccgagacggtagaaattcgacttcgccagctgctgagttgaatcagtatactggccttaacgctgcgggtgctcatcggccttatttagggttcgaaaacgatccgcaagaacaacagcgtattcaaacattggcaaggacgttaacgaattcatccattgctagtaaacagaactctagtgtaggagcccagggcataaacaacggtaatcacgggcaagatactgcggatgcagacagttcgacaaacgaatcgctacaacgcacccttacaagagcttccttgcatatcaatccagatgatgtgaaaatcccattcgatgaagacgctagaagtgctgaccctagattggatccatattcagctaattttgattccaaattttgggttcagactatgcatcagatgttcaactccgacccggattactacaaaccagtgagtctgggtgtatgcttgaaagggttaagagtttcaggtgtgtcagtggatgcagattaccaggcaactgttgcgaacgctcctttgaaagtattaaatgcagctcgtcatttcgtatcaaaacgtgatgaatcccgttattttgatatcttgcggccaatggatgcccttttcgaacctggtagactttgtaccgtgctaggtagacctggtgctggttgctcaactcttttaaaaacagtatccgcaagaacttacgggtttaccgttagacccgaatccgtaatctcatacgatggtatctctcaacatgatatcgagaaacactacagaggtgatgttatctactctgctgaaatggattatcattttgccaatttaaatgtcggctacactttggaatttgctgctagatgtagatgcccctcggcaagaccacaaggtgtcagtagagaagaatattacaagcattatgccgcagtggtcatggctacttacggtttatcccacacgtactcgacaaaagttggtgatgattacgtcagaggtgtttctggtggtgaacgtaaacgtgtttctatcgctgaagtgactttggctggggccaaggtacaatgttgggataatgccactcgtgggttagattccgcaacagccttagaatttgtaagagcgttgaaaacgaatgctaccatttcaagaactactccattactagctatttatcagtgttcccaagatgcctatgatctatttgatgatgttttggttctatatgagggtcgccagatttatttcggtcctgcagactccgcaaaacaatacttcttggatatgggttgggagtgtcctgatagacaaacgactgcagatttcttaacatcagtaactgctgctaatgaaagaaagtgtagaccaggctacgaaaagaaggttcctaagacacctgacgaattttatgagcattggaaatcatcatctgaatatgcccaactaatgaacaggattgatgcctatttgaataaacataacaatgaggatagcgcaaaagagtttttcgatcatcacactgctcgtcaatcgaagcattccaagtcatcttcacccttccttttatcatttatgatgcaagtgaaagccgtcatggacagaaacgtccagagacttaaaggtgacccatctgtttacgcatttaacatttttggtaattgctcgatggctttcatcatttcttctatgttttataaccaaaaggataataccggttcattttactacaggactgctgcgcttttcacggcgcttttgtttaactcctttggttctttattagaaattctttccttgtttgaggcaagaaagattgtcgagaagcataaaacctatgcattttatcgtccttcagcagatgctttggcatcaattattaccgaattaccatctaagtttatcatcgctatttgcttcaatttaatctattacttcttagttaatttcagaaggtcaccaggtcatttctttttctatttcttaattgcaattacatcaacattcacaatgtcacatttattcagatcaattggtgccgcctgtacgaccttggaacaagccatgttaccggctagtattttgttgttaattttatccatttacgccggtttcgtcattcctaagggcaatattcttggttggtcgaaatggttgtattatttgaacccaattgctagatctatggaagcaatggtagcgaacgagttcgctggaagaacctttgagtgttcgcaatttattccagcaggtggggagtacgatgaactaccattagcacttaaaatatgttctgttgtcggttctgaaccagggtctgcatatgttagcggtactgcatacatggaagagtctttttcttataaagacagttacagatggagaaattggggtattgttctttgttatgctgttttcttccttgcggtatatttactattaatcgagtataacaaaggtgagatgcaaaagggtgagatgacagtcttcccaaggtccgtcttaatgaagctcaaaaagaagaatcagaacttgaaaaatgatatcgaatcgaatgacagtttactaaaagacatgacaaacgggaatgattcccaagacgaaaaaagtgatagctccaatgaaaagatggctgaaaagattggatctgaccaagtggtattttggaagaatatctgttatgatgttcaaatcaagactgaaacgagaagaattttggataatgttgatggttgggtcaagcctggaactttaactgcactaatgggatcatcaggtgctggtaagactactttgttggatgctttggctgaccgtattagcacaggtgtcattaccggtgacgtcctcgtaaatggtagaccaacagatgcatccttccaaagatcaacgggatattgccaacaacaggatttgcatggacgtactcagacagtaagagaagctttgactttcagtgcgtacttacgtcagccatacaatgtttcgaaaaaagagaaagatgaatatgttgaaacgattattcgtcttttagagatggaaacgtacgctgatgctttagttggtgtgactggtgaaggattaaatgtggaacaaagaaagagattgactattggtgttgaattagtggcaaaaccaaagttactattgtttttggatgaacctacatctggtttggattctcaaacggcatggtcagtttgtcagttgatgaggaaattagcaaaccacggacaagctattttgtgtactattcaccaaccttccgctatattaatgcaagagtttgacagattgcttttattgcaaaagggaggacagactgtgtattttggcgagttgggtcatggatgttgcaagatgattgagtatttcgagtccaaaggatcgcagaaattccctgctgattgtaatccagctgaattcatgttacatgttattggagctgcccctggttcacatgtcaccaccgactatcataaagtctggcttgaatctcaggagtatcaagctgtccaaaaggaaattgacagaatgtcacgcgagatggttaacattcctcaagaagactcagaggatttgaaaaaggaatttgccacgccattatggtaccaattcctaataatgactagaagagtactagaacagcattggagatcgccaatatatatttatgccaaaattttcactacttctttttctgctttattcatcggattctcatttttcaatgcgaataatagtatgcaaggcctacaaaaccaaatgttttctctattcatgcttttagtcatgttcagtcctcttgttcatcagatgttgccacaatataccgatcaaagagatctttacgaggtgagagaaagaccttccaagacttgctcgtggataacttttgtattatcacagattgcagcggaacttccatggagtttcctcataggtacaattacctatttctgtttctactacccggttggtctttacagaaatgcacctaacacggaacaagtacacgaacgtggtgcacttttctggttaatttgtatcgcattcattaatttcacaatgacattcggacaagcctgtattgctggtgttgaacgtagggagaatgccgctttgctagctaataactgtttcatgatatgtttagcattctgtggtgttttggttaccagagataagttgccaggtttctggaaattcatgtattacttatcgcccttcacgtatttgatatctaccatgttagctaccgcagtcggaaactctgatgtgcgctgctcagccaaggaatacctccatttttcaccagctcccaatatgacatgccaacaatacatgtctccatatatgagtgttgccggaggttaccttttggacggaaatgcaaccgattcttgcggattttgtgttatggctgaaacaaatgtctacttggctactgtaaacatcaaatatagccaaatttggagaaattggggaatattcttatgttatattggcgcaaatgtgttcctcttcgtattgctttactgggctttcagggttccaagagaccactaccttctaattaagatccatgccatcaagtcaaagatcactaattctctcaaaagtagaaaattgattagatcttccaagaacaatgaggcctaa

SEQ ID NO: 124 - protein, 1560 aa, Kluyveromyces lactis
MSDDSGSSIDDRDGRNSTSPAAELNQYTGLNAAGAHRPYLGFENDPQEQQRIQTLARTLTNSSIASKQNSSVGAQGINNGNHGQDTADADSSTNESLQRTLTRASLHINPDDVKIPFDEDARSADPRLDPYSANFDSKFWVQTMHQMFNSDPDYYKPVSLGVCLKGLRVSGVSVDADYQATVANAPLKVLNAARHFVSKRDESRYFDILRPMDALFEPGRLCTVLGRPGAGCSTLLKTVSARTYGFTVRPESVISYDGISQHDIEKHYRGDVIYSAEMDYHFANLNVGYTLEFAARCRCPSARPQGVSREEYYKHYAAVVMATYGLSHTYSTKVGDDYVRGVSGGERKRVSIAEVTLAGAKVQCWDNATRGLDSATALEFVRALKTNATISRTTPLLAIYQCSQDAYDLFDDVLVLYEGRQIYFGPADSAKQYFLDMGWECPDRQTTADFLTSVTAANERKCRPGYEKKVPKTPDEFYEHWKSSSEYAQLMNRIDAYLNKHNNEDSAKEFFDHHTARQSKHSKSSSPFLLSFMMQVKAVMDRNVQRLKGDPSVYAFNIFGNCSMAFIISSMFYNQKDNTGSFYYRTAALFTALLFNSFGSLLEILSLFEARKIVEKHKTYAFYRPSADALASIITELPSKFIIAICFNLIYYFLVNFRRSPGHFFFYFLIAITSTFTMSHLFRSIGAACTTLEQAMLPASILLLILSIYAGFVIPKGNILGWSKWLYYLNPIARSMEAMVANEFAGRTFECSQFIPAGGEYDELPLALKICSVVGSEPGSAYVSGTAYMEESFSYKDSYRWRNWGIVLCYAVFFLAVYLLLIEYNKGEMQKGEMTVFPRSVLMKLKKKNQNLKNDIESNDSLLKDMTNGNDSQDEKSDSSNEKMAEKIGSDQVVFWKNICYDVQIKTETRRILDNVDGWVKPGTLTALMGSSGAGKTTLLDALADRISTGVITGDVLVNGRPTDASFQRSTGYCQQQDLHGRTQTVREALTFSAYLRQPYNVSKKEKDEYVETIIRLLEMETYADALVGVTGEGLNVEQRKRLTIGVELVAKPKLLLFLDEPTSGLDSQTAWSVCQLMRKLANHGQAILCTIHQPSAILMQEFDRLLLLQKGGQTVYFGELGHGCCKMIEYFESKGSQKFPADCNPAEFMLHVIGAAPGSHVTTDYHKVWLESQEYQAVQKEIDRMSREMVNIPQEDSEDLKKEFATPLWYQFLIMTRRVLEQHWRSPIYIYAKIFTTSFSALFIGFSFFNANNSMQGLQNQMFSLFMLLVMFSPLVHQMLPQYTDQRDLYEVRERPSKTCSWITFVLSQIAAELPWSFLIGTITYFCFYYPVGLYRNAPNTEQVHERGALFWLICIAFINFTMTFGQACIAGVERRENAALLANNCFMICLAFCGVLVTRDKLPGFWKFMYYLSPFTYLISTMLATAVGNSDVRCSAKEYLHFSPAPNMTCQQYMSPYMSVAGGYLLDGNATDSCGFCVMAETNVYLATVNIKYSQIWRNWGIFLCYIGANVFLFVLLYWAFRVPRDHYLLIKIHAIKSKITNSLKSRKLIRSSKNNEA

SEQ ID NO: 125 - DNA, 4203 bp, Saccharomyces castelli
  misc_feature (193)..(193): n is a, c, g, or t
atgtcaatttccaagtatttcactccagtgcaggatgcttctgtcacttttgatggggcgaatgtcaaagtgagaacatcactcttcgatgattctaacgatgatatcgaatctcaacaattactgtcatcagctgctgtttctgaaaaaccaaaaaatatattaaacgatctgacctttaaggcagatgaangtgaagtggtcctagttttaggtgctcccacttctgaacttttccaagcattattccatggtcataaaagcttaaaatataaacctgagggatcaattagattcaaggataatgaattcaaggcatttttcttcaaatgtcctcaagaaattatttacaataacgaacaagatatccatttcccatttttaactgttagacaaacaatcgattttgcattgagctgtaagttccacatcccattggaggaacgtaaccaaatgagagatgaattattaaatgggttcggtctttctcatgtcgttgacacatttgttggtaacgattatgttcgtggtgtttctggtggtgaacgtaaacgtatttccattattgaaacattcatcgctaacggttccgtttatctttgggataactctaccaaggggttagattcttcaaccgccttagagtttctttccatcttacaaaccatggcaagaaccacacgttctgtcaattttgttaagatttctcaagctagtgataagattgtcgaaaaatttgacaaaatcttaatgttgactgaatcttatcaagtattttatggtaccgtcgatgaatgtttagtatacttccgtgacactttgggtattcagaaggatccaaatgattgtatcattgaatatctaacatccatcttaaatttccaattcattaataaggatattaataacccattgtcaccagttcaatcgcaaaagagtgtgagaagctcaattgccaacaacgaaattgacttatacaactattggattaagtcaccatactatgccaactggaagaaaattacttccgacagtattaaagacatgccaactagagactctgtcaatccagatgacatcaaaccaattttcagtattccattaaagttacaattgaaggcttgtactattagagctttcgaaagaattattggtgataagaattatatcatttcccaatttgtttctgtcatcgttcaatctttggttatcggttccttattttatgaaattccacgtactactattggttccttctcaagaggttctctagttttcttctctattctgtttttcactttcttagccctggcagatatgccatcaaatttccaaagaaatgccgttgttaccaaacatgtccaattacatttctactacggttgggttgaagcattagcctccacaatttatgattatatcttcaagtttattctggttgttatatttaccattattctgtatttcttagctcatttgcaatacaatggtgctagatttttcattttcctactgttcctgtcattctacaatttctgtatggtgtcattattcaattggacagctttgttaagtccaactatttcattcgcaaatttgcttgcaggtatcgttctattggctattgccatgtacgcttcttatgtgattcatttgccagatatgcatccatggtttgtttggatcgcttacttaaatcctgctatgttcgctatggaagctatgctaaccaatgaattgtttgatatcaacttggattgtaccgaaagtattatccctagaggtccaagttatgataacattacttttgctcataaagcttgtgcttggcaaggtgccaccctgggtaacaattatgttagaggccaagattatttgaaatcaggtttaaaatatagatacagtcacgtttggagaaattttggtatcattatagggttctgttgtttcaatttagtctgttctttgctaactgctgaatacattactccactttacacaagaaagaatattcttctatggtcaagttacattgctaggtacaatccattgagcagaaagaaaaaggaacaagaatatgaaatggatgaatacgaaaagggtaataacaaacgtccaatttcttcttcctcatcctctttatctcttggtgctggtattgctgatgatgattccattaaagctcctattacttctcaatatgacaagtctgctaccgtccaaactcaaaagcatgtcatttcatggagaaatatcaactatacagttgaaggtgacaaacagttgattaatgattgttctgggtttatcagttctggtttaaccgcccttatgggtgaatctggtgctggtaagacaactttgttaaatgttttatctcaaagagttacatctggtgaggttactggtgaattgttaatcgatggtcaaccattaactaacattgctgcctttagaagaagtattggttttgttcaacaacaagatgttcatttggatctattgactgttaaagaatctttggaaatctcatgtatcttaagaggtgatggtgatagagattatttgggtactgtcgctaagttattgaagttaccagctaacaccttggttgctgatctaactccaactgaaaagaaactattgtccatcggtgtcgaattggttaccaagccttcattgttattattcttagatgaaccaacttctggtctagatgctgaagctgcattaactattgttcaattcttaaagaaactgtctttacaaggtcaagctattttatgtactatccatcaacctagtaagagtgttatcaaatatttcgataatatttatttgttaaagagaggtggtgaatgtgtttactttggtcatattgatgatggttgtgattacttcctaacccatgacgagcatttgacttacaacaaggaaactgaaaatccagctgatttcgttattgatgtcgttggtggtaagcaaaaggatggagatggtgtattgattgaaaagcctaagataaactggacccaactttgggacgaatcaccggaaagggaacaaattcatcaaaacctggatacgttagaagaagaagcacgtcattcaggtgtcgatttcgttcaatttgcttggagtcaaccatcttactggcaacaattaatcgttattctaagaagacaatatatttgcacaaagagggataccaattatgttctctccaaattcttattgaatgctggtgcaggtttgtttatcgggttctcattttggaagacaaagaagaatatttctggtctacaaaatgctattttcttgtcctttatgaacatgtgtctatcctctccattaattaaccaaattcaagataaagctttacactctaaagatgtttacgttgctagagaagcaagttctaatacctatcattggactgtcctattattggctcaaacgttagtggaattaccattggcaatctctagttctaccttatttttcttatgttgctacttctgttgtgggtttgataattctcctcatattgctggtgtgttttacttcaactatattctattcagtgcttactacttgacatttggtctatggttactatatactgcaccagatttacaaactgctgccgtttttgttgctttcttgtatagtttcacagcatcattctgtggtgttatgcaaccatacagtttgttcgtcggtttctggaagtttatgtacagggtttcaccatacacgtacttcattgatacgtttgttagtttgttacttcacgatagacctgtacagtgttctgtcggagaaatggttcctggacaacctttgccaggtcaaacatgtggtcaattcatggctccatttatcgctgaccaaggtgggtacttacataatccaaaaactttcacagtctgtggttactgtacctacactgttggtgatgatttcttggcagttgaaaatatgagttattcaaacagatggagaaacttcggtattgaatgtgcttttgttgttttcaatttcgttgcaatgtttattggtttctatctaacatacgtgaaacaagtctggccatcagtctatgctttctgtatgaaggctgttccaagaaacgttttcaagaaaaagaccgaagatgtttctaccattactgttgaagattctgaggacaaaaaagcatag

SEQ ID NO: 126 - protein, 1400 aa, Saccharomyces castelli
  misc_feature (65)..(65): Xaa can be any naturally occurring amino acid
MSISKYFTPVQDASVTFDGANVKVRTSLFDDSNDDIESQQLLSSAAVSEKPKNILNDLTFKADEXEVVLVLGAPTSELFQALFHGHKSLKYKPEGSIRFKDNEFKAFFFKCPQEIIYNNEQDIHFPFLTVRQTIDFALSCKFHIPLEERNQMRDELLNGFGLSHVVDTFVGNDYVRGVSGGERKRISIIETFIANGSVYLWDNSTKGLDSSTALEFLSILQTMARTTRSVNFVKISQASDKIVEKFDKILMLTESYQVFYGTVDECLVYFRDTLGIQKDPNDCIIEYLTSILNFQFINKDINNPLSPVQSQKSVRSSIANNEIDLYNYWIKSPYYANWKKITSDSIKDMPTRDSVNPDDIKPIFSIPLKLQLKACTIRAFERIIGDKNYIISQFVSVIVQSLVIGSLFYEIPRTTIGSFSRGSLVFFSILFFTFLALADMPSNFQRNAVVTKHVQLHFYYGWVEALASTIYDYIFKFILVVIFTIILYFLAHLQYNGARFFIFLLFLSFYNFCMVSLFNWTALLSPTISFANLLAGIVLLAIAMYASYVIHLPDMHPWFVWIAYLNPAMFAMEAMLTNELFDINLDCTESIIPRGPSYDNITFAHKACAWQGATLGNNYVRGQDYLKSGLKYRYSHVWRNFGIIIGFCCFNLVCSLLTAEYITPLYTRKNILLWSSYIARYNPLSRKKKEQEYEMDEYEKGNNKRPISSSSSSLSLGAGIADDDSIKAPITSQYDKSATVQTQKHVISWRNINYTVEGDKQLINDCSGFISSGLTALMGESGAGKTTLLNVLSQRVTSGEVTGELLIDGQPLTNIAAFRRSIGFVQQQDVHLDLLTVKESLEISCILRGDGDRDYLGTVAKLLKLPANTLVADLTPTEKKLLSIGVELVTKPSLLLFLDEPTSGLDAEAALTIVQFLKKLSLQGQAILCTIHQPSKSVIKYFDNIYLLKRGGECVYFGHIDDGCDYFLTHDEHLTYNKETENPADFVIDVVGGKQKDGDGVLIEKPKINWTQLWDESPEREQIHQNLDTLEEEARHSGVDFVQFAWSQPSYWQQLIVILRRQYICTKRDTNYVLSKFLLNAGAGLFIGFSFWKTKKNISGLQNAIFLSFMNMCLSSPLINQIQDKALHSKDVYVAREASSNTYHWTVLLLAQTLVELPLAISSSTLFFLCCYFCCGFDNSPHIAGVFYFNYILFSAYYLTFGLWLLYTAPDLQTAAVFVAFLYSFTASFCGVMQPYSLFVGFWKFMYRVSPYTYFIDTFVSLLLHDRPVQCSVGEMVPGQPLPGQTCGQFMAPFIADQGGYLHNPKTFTVCGYCTYTVGDDFLAVENMSYSNRWRNFGIECAFVVFNFVAMFIGFYLTYVKQVWPSVYAFCMKAVPRNVFKKKTEDVSTITVEDSEDKKA

SEQ ID NO: 127 - DNA, 4638 bp, Saccharomyces kluyveri
atgtcttcaacagaaggatcgcagatttcgcgaacagacagcttctgcaccaccagggaagacccagaagaacaatcatattctgctgacattgcgccggcaaatacagtataccggggcctgcggaatgacccgcaggagcaaaaccaaattagagagctagccaggacctttagcagaaggtccttggcgtccatatccagaaactccatgcacagcaccgagagcaagacgcagtctcaccgcgaaaaggacgccgaccagggcccaggcagcaccctgcacgtcccgggagaggtgccgttttctgacaaccacatcgaccccaggctggacccaaagtccgacgagtttgactcgatgttctgggtccagaacctgcgcaagctgtacctttccgacaaggactactacaagcccgtggagctgggcgtctgtttgaagggcctcagggtctcgggcatctcgaaccaggcagactaccagagcactgtgctgaacctgccgttcaagctggcgggacagctgcacacgctgctgttcgacagaaagcaggagtccaggtactttgacatcctgaaacccctcgacgcactgttcgagccgggcaggctgtgtgcggtgctaggacggcctggcgccggctgctcgacgctgctaaagacggtgtctgcgtccacctatgggttcaaggtccagccagagtcggtggtctcgtatgacggaatcacccagcgcgagatcctcaaccactacagaggcgacgtcgtgtactcgtccgaggtggacgaccactttgcaacgctgcccgtgggctacacgctcgagtttgccgcacgctgccggtgcccgagaaacagacccgagggcgtcaccagggagcagtactacaagcactacgcagcagtgacgatggccacgttcgggctctcgcacacctacgacacaaaggtcggcgacgactacatccggggggtttctggcggtgagcgcaagcgggtgtccatcgcagaggtcacgctggccgggtccaaggtgcagtgctgggacaactccacgaggggcctggactctgccaccgcgctggagtttgtcagggcgctaaagacaaacgcggaggtggccaggaccacgtcgctggtggcggtgtaccagtgctcgcaggacgcgtacaacctgttcgacgacgtcagcctgctgtacgaggggtaccagatctactttgggagcgccagtgctgccaagcagtactttctggacatggggtgggcgtgtccgccgcgtcagaccaccgcggactttctcacgtcgctcacgtcgccgtccgaaaggcaggccaggccagactgcgagcacaaggtcccgcgcacagccagggagttctacgatacctggcaggcgtcacccgaatacgctagcctggtggccaggatcgacgagcggctggcacggttccaggacggggccaccgcggcgcggctgaaggaccagtacacgtccatgcacgccaggcaggcaagaaacgcgtcgccgttcctgatctccttcggcatgcaggtgaaggccgtgattgacagaaacttcaaaagaatcaagggcgacccctcggtgtacctgttcaacatcatcgccaactcgttgatggggctgctcatctcgtcgatgttctacaaccagaagaacaacacggacagcttttacatgcgggcctcgtccctgttcacggccgcgctgttcaactcgttctcgtcgctgctggaaatcatggcgctgttcgaggcccggaagatcgtggagaagcacaagcggtacgccttctaccacccctccgcggacgcgctggcgtcgatcatcacggagctgccgtccaagatcctggtgggactcgggttcaacctgaccttctacttcatgatcaacctgaggaggaccccgggccactttttcttctacttcctgatcaccatgacctccacctttgccatgtcccacctgttccggaccatcggtgcggcgtcgacgtcgctgcccgcggcactctccccggccgtgctgctgctgctggtgattgcgatctacgtcggctttgtcatccccaagggcagcatgctggggtggtctaagtggttgtactacctgaacccgattgcgaggagcatggaggcgctggttgccaacgagtttgctggcaggacgttcgagtgcgccagctttgtcccagccgggcccggatacgaggactatcccctggcaaacaagatctgctcggtggtgggcgcggtcagcggcagcagcactgtctcgggaacggtgtacatagaagaggcgtactcgtactacagcaagcatcggtggaggaactggggcatcgtgctctgctacgcggtcttcttcctggccgtgtacatggttctgatcgagtacaacaagggcgagatgcagaagggggacgtggtgctgttcaccaggtccgccttgacacgcctgtccaaggcaaacggcgctctgaagggcgacatcgagtcgaacgacggcgctctgacgcagctgggtcccgcagaagtgggtggcagggaaaaggacgagagcggaaaggacagcagaggaacggacagcagtgggaagaccagcagcgaagagggcggcttcctgcgcaaaatcggttccgacgatattttccactggaaacaggtttgctacgacgtgaaggtcaagggcggaacaagaagaatcctgagcgaggtggacggctgggtcaaacccgggacactaacggccctgatgggcagctctggtgcgggaaaaacaacgctgctggatgtcttagccaaccgtgtcaaaaccggcgtcatcacaggccagatgtttgtcaacgggcatccgcgcgacgagtcgttccagaggtccaccgggtactgccagcagcaggacctgcacggccgcacagacaccgtgagggaggctctgcagttctctgcccacttgcgtcagccgcggagcgtttccaggctcgaaaaggaccagtacgtggaggaggtgatccagctgctcgagatggagcagtacgcggacgctgtcgtgggagttgctggggagggcctgaacgtggagcagagaaagaggctgacaatcggtgtcgagctggttgccaagcccaagctgctgctgttcctggacgagccaacttccggactggactcgcagaccgcatggtccgtctgccagctgatgcggaagctggccaaccacggccaggcaatcctgtgcacgatccaccagccatccgcgatcctgatgcaggagtttgaccggctgctgctgctggccaagggcggcaagaccatatattttggcgacctgggcaagggctgccacagtatgatcaagtactttgaaaggtgcggcagcgaaaagtttccgagcaactgcaacccggccgagttcatgctgaaggtcatcggcgcagcgcccggcagccacgccaaacaggactaccacgaagtttggaagcgttctgaggaatacaggggcgtgcaggaggagctggcgcggatggaagcagagctggtcaaaaagccggtggaggactccgaggagttgcaccgcgagtttgccagcccgttgctgatgcagtactttgtcgtcaccaagaggatctttgtacagcagtggaggacgccggggtacatatgggccaagatcgcaacgtcggtgtttgcgtcaatcctgctcgggttctcgtttttcaaggccaacaactcgctgcagggcctgcagaaccagatgttttcgatgctgctttacacggtgatgatcaacccgctggtccagcagatgctgcctcagtactgcgaccagcgggacctgtacgaggtccgggagaggccctcaaagaccttttcctggaaggtgtttgtgctgtcgcagaccactgcagagctgccgtggtgtatcttcatcggtacgctgtcctttttctgcttctactaccccgtggggctctaccgcaacgccgaaaacacctcgcagctccacgagcgtggagctctgttctggctgctgtgcgtgggcttccacgtgttctccataacatacgggcagctgtggatggcggggatcgagcagtaccgaaacgccgcaatgctcgccaacacctgctacatgctgtcgatgaccttttgcggtgtgctggtcagcaaggacaagatgcccgggttttggaagttcatgtacagggtctcgccgatcacatacttcatctccgccatgcttgcggtgggtgtgggcaacacggagatctcgtgctccaagaaggaatacctgcactttgacccgcccagcgggacaacgtgcgggcagtacatgaagccgtacatctcgtacgcctcgggctacctactcgacgaggacgccaccgctgactgcagcttctgcaggctaaagtacacgaacacctacctggaaaccgccaacattttctacagccagcggtggaggaactgggggatatttctgtgttacccggtcatcaacattatcgggttctgcctgttgtactggatgttcagggtcccaaagtccaagcgcatcgcctttcagctaccgttcatgtccaagaagggctccgaagctagctag

SEQ ID NO: 128 - protein, 1545 aa, Saccharomyces kluyveri
MSSTEGSQISRTDSFCTTREDPEEQSYSADIAPANTVYRGLRNDPQEQNQIRELARTFSRRSLASISRNSMHSTESKTQSHREKDADQGPGSTLHVPGEVPFSDNHIDPRLDPKSDEFDSMFWVQNLRKLYLSDKDYYKPVELGVCLKGLRVSGISNQADYQSTVLNLPFKLAGQLHTLLFDRKQESRYFDILKPLDALFEPGRLCAVLGRPGAGCSTLLKTVSASTYGFKVQPESVVSYDGITQREILNHYRGDVVYSSEVDDHFATLPVGYTLEFAARCRCPRNRPEGVTREQYYKHYAAVTMATFGLSHTYDTKVGDDYIRGVSGGERKRVSIAEVTLAGSKVQCWDNSTRGLDSATALEFVRALKTNAEVARTTSLVAVYQCSQDAYNLFDDVSLLYEGYQIYFGSASAAKQYFLDMGWACPPRQTTADFLTSLTSPSERQARPDCEHKVPRTAREFYDTWQASPEYASLVARIDERLARFQDGATAARLKDQYTSMHARQARNASPFLISFGMQVKAVIDRNFKRIKGDPSVYLFNIIANSLMGLLISSMFYNQKNNTDSFYMRASSLFTAALFNSFSSLLEIMALFEARKIVEKHKRYAFYHPSADALASIITELPSKILVGLGFNLTFYFMINLRRTPGHFFFYFLITMTSTFAMSHLFRTIGAASTSLPAALSPAVLLLLVIAIYVGFVIPKGSMLGWSKWLYYLNPIARSMEALVANEFAGRTFECASFVPAGPGYEDYPLANKICSVVGAVSGSSTVSGTVYIEEAYSYYSKHRWRNWGIVLCYAVFFLAVYMVLIEYNKGEMQKGDVVLFTRSALTRLSKANGALKGDIESNDGALTQLGPAEVGGREKDESGKDSRGTDSSGKTSSEEGGFLRKIGSDDIFHWKQVCYDVKVKGGTRRILSEVDGWVKPGTLTALMGSSGAGKTTLLDVLANRVKTGVITGQMFVNGHPRDESFQRSTGYCQQQDLHGRTDTVREALQFSAHLRQPRSVSRLEKDQYVEEVIQLLEMEQYADAVVGVAGEGLNVEQRKRLTIGVELVAKPKLLLFLDEPTSGLDSQTAWSVCQLMRKLANHGQAILCTIHQPSAILMQEFDRLLLLAKGGKTIYFGDLGKGCHSMIKYFERCGSEKFPSNCNPAEFMLKVIGAAPGSHAKQDYHEVWKRSEEYRGVQEELARMEAELVKKPVEDSEELHREFASPLLMQYFVVTKRIFVQQWRTPGYIWAKIATSVFASILLGFSFFKANNSLQGLQNQMFSMLLYTVMINPLVQQMLPQYCDQRDLYEVRERPSKTFSWKVFVLSQTTAELPWCIFIGTLSFFCFYYPVGLYRNAENTSQLHERGALFWLLCVGFHVFSITYGQLWMAGIEQYRNAAMLANTCYMLSMTFCGVLVSKDKMPGFWKFMYRVSPITYFISAMLAVGVGNTEISCSKKEYLHFDPPSGTTCGQYMKPYISYASGYLLDEDATADCSFCRLKYTNTYLETANIFYSQRWRNWGIFLCYPVINIIGFCLLYWMFRVPKSKRIAFQLPFMSKKGSEAS

SEQ ID NO: 129 - DNA, 2290 bp, Saccharomyces bayanus
atgagcagtataaaaaacgcacatggcggctcgaaagatagccccgtaacgagaagctcaagcgcctcgtcggcaacttcagaagtgtcattttctggcactgcccacggtaaagatgaacagaatgataccctggcacatagacactccaaaacgcttatagggcatgcaaaggacagcatgagtcagctcagcgctaccatgtccaatatgtcgccagatgtcatctccaaagtggaatatctggcggatgcactatctcgttatacaacaaggagcggcgcctttaacatggattcaggcgatgggttcgatgcgcacgccatctttgaaagtttcgtcagagacgccgatgaacaaggtatccatattcgtaaagccggtgtcaccatagagaacgtgggggcccaaggttccgatgaaagtgctctggagggcgctaccttcggtaacatactgtgtctaccattaactatcatcaaaggtatcaaggcaaagaaacagaaaaaaatgagagacattatacagaacgttaatgcattagcagaagctggtgagatggtcttggtccttgggagaccaggtgccggctgctcttcctttttgaaggttactgctggtgaaattgaccaatttgctggtggcgtcagcggcgatgtagcatatgacggcatcccacaggaggagatgatgaagagatataaagcagatgttatctacaacggtgaattagacgttcatttcccctacctgacggtcaagcaaacattagatttcgctatagcctgcaaaacgcccgcagtaagagtgaataacatttcgagacaggaatatattgaaaatagaagagatctatttgccacaattttcggtctaagacatacttatagtaccaaggttggtaacgattttgttagaggtgtatccggtggtgaacgtaagcgtgtttccattgcagaagcgttggctgctaagggttctatatactgttgggataatgccacaagaggtctagacgcttctacggctttggaatatgcaaaagcaattcgtatcatgaccaacttgttgaaatctaccgcatttgtcacgatttatcaagcgagtgaaaatatttacgaaacttttgataaggttactgtcctttattccggtagacaaatttactatggtctaattcatgaagcaaagccatatttcgcaaaaatggggtacctgtgtcctccaaggcaagcaactgctgaattcctaactgcgttaacagatccaaatgggtttcataaaatcaagccaggttacgaaaacagagttccaaggactgcaaaagaatttgaaacctattggctgaactctccggaatttgttcaattgagaaatgatattgctgcttacaaagccagagttaataccgagaaaacaaaagaaatttatgatgtatcaatggctcaagagaagtctaaatacacaagaaataaatcttactacaccatttcatattgggaacaaatcaggctttgtacacaacgtggattccagagaatttacggtaacaagagttacacagtcatcaatgtttgctccgccatcattcaatcttttattactggttcgttattctataataccccctcatctacttcgggtgcattttcaagaggtggtgttttgtacttcgccctattgtactactccttgatggggttggctagtatttctttcgagcatagaccgatcttacaaaaacacaaaggttattctctataccatccttcagccgaggccatcggttccactctagcagctttcccctttagaatgattggtttgacatgtttcttcattattttattcttcttatctggattacatagaacagcaagttcatttttcattatctatttgttcctaatcatgtgttcagaagcaattaatggtttatttgaaatggtttcctccatgtgtgacactctttctcaagcaaactctatcgctggtattttgatgatgtccatctccatgtattctacatatgttattcagctaccttcgatgcacccatggttcaaatggatttcctatatcctacctatcagatatgctttcgaatctatgctgaacgccgaatttcatggtaggcacatggactgtgccgatactttagtacctagtggaggaagctatgataatttatctattgactacaaaggttgcgcattcgttggttcaaaagccggccagtcctacgtgcttggtgatgattaccttgaaaagtcaattccagtacgtctat

SEQ ID NO: 130 - protein, 763 aa, Saccharomyces bayanus
MSSIKNAHGGSKDSPVTRSSSASSATSEVSFSGTAHGKDEQNDTLAHRHSKTLIGHAKDSMSQLSATMSNMSPDVISKVEYLADALSRYTTRSGAFNMDSGDGFDAHAIFESFVRDADEQGIHIRKAGVTIENVGAQGSDESALEGATFGNILCLPLTIIKGIKAKKQKKMRDIIQNVNALAEAGEMVLVLGRPGAGCSSFLKVTAGEIDQFAGGVSGDVAYDGIPQEEMMKRYKADVIYNGELDVHFPYLTVKQTLDFAIACKTPAVRVNNISRQEYIENRRDLFATIFGLRHTYSTKVGNDFVRGVSGGERKRVSIAEALAAKGSIYCWDNATRGLDASTALEYAKAIRIMTNLLKSTAFVTIYQASENIYETFDKVTVLYSGRQIYYGLIHEAKPYFAKMGYLCPPRQATAEFLTALTDPNGFHKIKPGYENRVPRTAKEFETYWLNSPEFVQLRNDIAAYKARVNTEKTKEIYDVSMAQEKSKYTRNKSYYTISYWEQIRLCTQRGFQRIYGNKSYTVINVCSAIIQSFITGSLFYNTPSSTSGAFSRGGVLYFALLYYSLMGLASISFEHRPILQKHKGYSLYHPSAEAIGSTLAAFPFRMIGLTCFFIILFFLSGLHRTASSFFIIYLFLIMCSEAINGLFEMVSSMCDTLSQANSIAGILMMSISMYSTYVIQLPSMHPWFKWISYILPIRYAFESMLNAEFHGRHMDCADTLVPSGGSYDNLSIDYKGCAFVGSKAGQSYVLGDDYLEKSIPVRL

SEQ ID NO: 131 - DNA, 4002 bp, Saccharomyces cerevisiae
atggaatgcgtttcagtagaaggtttggattcttcttttttggagggccaaacctttggcgatattttgtgtttaccatggacaattatcaagggtatccgtgagcggaagaatcgcaataagatgaagatcattttgaagaatgtcagtttgctggctaaatcaggagagatggtccttgtcctaggaagaccaggcgctggctgtacatcatttttaaagagcgctgctggtgagaccagtcagtttgcaggtggtgtaacaacaggacatatatcgtacgatggtatccctcagaaagaaatgatgcaacattacaagccagatgtaatctataatggtgagcaagatgttcatttcccacatttgacagtaaaacaaactctagattttgctatttcctgtaagatgcccgcaaaaagagtcaataatgtaacgaaagaagagtatattactgccaatagagaattctatgctaaaatttttggtttgacgcatactttcgataccaaagttggtaacgatttcatcagcggtgtatctggaggtgagcgtaaacgcgtttccattgctgaagcattagcagcgaaaggttcaatttactgctgggataatgctacaagaggtcttgactcttctaccgcgctagaatttgcacgagctattcgtactatgacaaatctgttaggtacaacggcccttgttacggtttaccaagccagtgaaaacatttatgaaacttttgataaagtcactgttctatacgctggaagacaaatattttgcggcaaaactactgaagcaaaagattattttgaaaacatgggttacttgtgtccaccgagacaatcgactgctgaatatttgaccgcaattactgatcctaatggtctgcacgaaataaagcctggctttgagtatcaagtacctcataccgctgatgaattcgaaaaatactggcttgattccccagaatatgcccgcctaaaaggtgaaattcagaagtacaaacatgaagtgaatactgaatggaccaaaaaaacatacaatgagtctatggcacaagaaaagtcgaaaggtacaagaaaaaaatcttattatacggtctcttattgggagcaaattagactttgcactattagaggtttcctaaggatttacggtgataagtcatacaccgttatcaacacatgcgctgctatagcacaggcttttatcactgggtcattgttctaccaagcaccttcttcaactctaggggccttttctagaagtggcgttctgtttttttccctcttatattattctttgatgggtttagctaatattagtttcgagcacaggccaatattgcaaaaacacaaggtctattcactatatcatccctcagctgaagcgttagcaagtacgatttcttcttttccattcagaatgattggtctaacatttttcataatcatcctgtacttcttagccggtttgcatagaagcgccggtgctttttttactatgtatttgttattgacaatgtgttcagaagctattacaagtttgtttcagatggtttcatctttatgcgatacattgtcccaggccaactccattgccggtgttgtgatgttatctattgccatgtattcgacgtacatgatacaattaccttcaatgcatccatggtttaagtggatttcgtacattctacccattagatatgcatttgaatcgatgttaaatgcagaatttcatggaagacatatggattgtggtggcactttggttccttctggacctgggtttgaaaacatcttgccagaaaatcaagtgtgtgcttttgttggttcaaggcctggccaatcttgggtcctaggtgatgattatttgagggcccaatatcaatatgagtacaaaaatacttggagaaacttcggcatcatgtggtgtttcttaattggctacatcgtcttgagggcggttttcactgagtacaaaagtcctgtcaaaagtggtggtgatgctctggtcgtcaagaagggcacaaagaatgctatacaaagatcatggagcagcaaaaatgacgaagagaaccttaatgcctctatagcaacacaggatatgaaagagatagcttcaagtaacgacgatagcacaagtgcagactttgaaggtttggaatctaccggggtgtttatttggaaaaatgtttctttcacaattcctcattctagcggacaacgtaaacttctggacagcgtaagcggttactgtgttcctggtactttgacagcattaataggtgagtccggcgctggtaagaccacattattaaacactttggctcaaaggaacgtgggaacgattactggtgatatgttagttgatggtctcccaatggacgctagtttcaaaaggcgtaccggttatgttcaacagcaagatcttcatgttgctgaacttactgtcaaagaatcgctacaatttagtgctcgtatgcgtcggccacagtctattcctgacgctgaaaagatggaatatgttgaaaaaattatatctattcttgaaatgcaggagttctcagaagctcttgtcggcgaaattggttacggcttgaatgttgaacagagaaagaaactatcaattggcgttgagctagttggcaagccggatctgttattgtttttggacgaaccgacctctggcttggattcccaatccgcgtgggccgtcgtcaaaatgttaaaaagattagctctagcaggtcaatcaattttatgtactattcatcaaccatcagctactctttttgaacagtttgacagattattgcttttgggaaaaggcggtcaaacaatttattttggtgaaataggtaaaaattcaagttctgtcattaagtatttcgaaaagaacggagccaggaaatgtcaacaaaatgaaaatccggcagagtatattttagaagccataggagctggggccaccgcttctgttcaacagaactggcctgatatatggcaaaaatctcacgagtatgcaaacattaacgaaaaaataaatgacatgattaaggacttatcttctacaactttgcataaaacagctacaagggcctctaagtatgcaacatcgtattcctaccaattccatcatgtgctgaaaagatccagtttaacattttggagaaacttgaactacatcatggccaaaatgatgttattgatgatcagtggcttgttcattggttttacctttttccatgtgggtgtaaatgctattggattacaaaatagcttatttgcctgtttcatggctatcgttatatcagctcctgcaacaaaccaaatacaggagcgtgctaccgttgctaaggagctatatgaagttcgtgagtccaaatctaatatgtttcattggtctttacttttgattacccattatttaaatgaattgccttaccatttattgttttcaacaatttttttcgtttcatcatatttccctctgggtgtctttaccgaagcctctaggtcaagtgttttttatctgaactatgccatactttttcaactttactatattggtcttgctttaatgattctgtacatgtctccaaatctacaatctgccaatgttattgtaggttttatactttcgtttttgctctctttctgcggtgctgtccaacctgcctctttaatgcctggtttctggacattcatgtggaaactatccccttacacgtattttttgcaaaatttagttggattattgatgcatgacaaacccgtaagatgttcaaagaaagagttgtctcttttcaaccccccggtaggccaaacatgtggtgaatttaccaaaccgttttttgaatttgggactgggtatattgcaaatccagatgcaacagcagattgcgcctattgtcagtacaaagtaggtgatgaatacttggcgcgcataaatgctagctttagttacttatggagaaacttcggtttcatttag

SEQ ID NO: 132 - protein, 1333 aa, Saccharomyces cerevisiae
MECVSVEGLDSSFLEGQTFGDILCLPWTIIKGIRERKNRNKMKIILKNVSLLAKSGEMVLVLGRPGAGCTSFLKSAAGETSQFAGGVTTGHISYDGIPQKEMMQHYKPDVIYNGEQDVHFPHLTVKQTLDFAISCKMPAKRVNNVTKEEYITANREFYAKIFGLTHTFDTKVGNDFISGVSGGERKRVSIAEALAAKGSIYCWDNATRGLDSSTALEFARAIRTMTNLLGTTALVTVYQASENIYETFDKVTVLYAGRQIFCGKTTEAKDYFENMGYLCPPRQSTAEYLTAITDPNGLHEIKPGFEYQVPHTADEFEKYWLDSPEYARLKGEIQKYKHEVNTEWTKKTYNESMAQEKSKGTRKKSYYTVSYWEQIRLCTIRGFLRIYGDKSYTVINTCAAIAQAFITGSLFYQAPSSTLGAFSRSGVLFFSLLYYSLMGLANISFEHRPILQKHKVYSLYHPSAEALASTISSFPFRMIGLTFFIIILYFLAGLHRSAGAFFTMYLLLTMCSEAITSLFQMVSSLCDTLSQANSIAGVVMLSIAMYSTYMIQLPSMHPWFKWISYILPIRYAFESMLNAEFHGRHMDCGGTLVPSGPGFENILPENQVCAFVGSRPGQSWVLGDDYLRAQYQYEYKNTWRNFGIMWCFLIGYIVLRAVFTEYKSPVKSGGDALVVKKGTKNAIQRSWSSKNDEENLNASIATQDMKEIASSNDDSTSADFEGLESTGVFIWKNVSFTIPHSSGQRKLLDSVSGYCVPGTLTALIGESGAGKTTLLNTLAQRNVGTITGDMLVDGLPMDASFKRRTGYVQQQDLHVAELTVKESLQFSARMRRPQSIPDAEKMEYVEKIISILEMQEFSEALVGEIGYGLNVEQRKKLSIGVELVGKPDLLLFLDEPTSGLDSQSAWAVVKMLKRLALAGQSILCTIHQPSATLFEQFDRLLLLGKGGQTIYFGEIGKNSSSVIKYFEKNGARKCQQNENPAEYILEAIGAGATASVQQNWPDIWQKSHEYANINEKINDMIKDLSSTTLHKTATRASKYATSYSYQFHHVLKRSSLTFWRNLNYIMAKMMLLMISGLFIGFTFFHVGVNAIGLQNSLFACFMAIVISAPATNQIQERATVAKELYEVRESKSNMFHWSLLLITHYLNELPYHLLFSTIFFVSSYFPLGVFTEASRSSVFYLNYAILFQLYYIGLALMILYMSPNLQSANVIVGFILSFLLSFCGAVQPASLMPGFWTFMWKLSPYTYFLQNLVGLLMHDKPVRCSKKELSLFNPPVGQTCGEFTKPFFEFGTGYIANPDATADCAYCQYKVGDEYLARINASFSYLWRNFGFI

SEQ ID NO: 133 - DNA, 4524 bp, Candida glabrata
atgagttcttcttcagagatctcggttgctggttcggacgtttccttcgaaggtagattgactcagcatggtcgtcacgaggagacgcctgctgaccaattgaccaagattctgagcggaagatcgcacgaagacgccgatggtgacgatgcgcacagcgacaacaggagtattctatcccgctcgcgccgtagctctaccgctgagctatccccagagatggttggccgtgtgcaatctctagccgatgtgctgtcgagacacacttcccgtagcggtggtaacattgacttgagccagctgtctgagagcgatagattcgatgccgaaaggattatcggctcatttgtcagagacgctgacgaacaaggtatccacttgagaaaagctggtgtaacgttggagcatgtcagtgccagaggtgccgactctaccgccatggaaggtgccacatttggtaacgtcctatgtcttccttacaccatttacaaagccatcagagacaaaagcggttcaaagatgcgtaccattctgaacgatgtcagtggtcttgctagagccggtgagatggttcttgtgctaggtagaccgggtgctggttgttcctctatgcttaaagtcactgctggtgaaattgatcaattcgctggtggtgttgaaggtgaaatcatgtatgatggtattccacagaaggagatgatgaaacgctacaagcccgatgtgatctacaacggtgaacaggatgtgcatttccctcacttgactgtacaacagaccttggatttcgccattgcgtgtaagactccatcaaagagagtcaacgatgtctctcgtgaagaatacatagcctccacaagagatctacatgccacaatttttggtctaagacatacatatcacactaaagttggtaatgacttcgttagaggtgtttctggtggtgaacgtaagcgtgtctccattgctgaagctttagtaactaaggggtccatctactgttgggataatgctactagaggtcttgatgcctctacagcactagaatacgctaaggctatccgtatcactaccaatcttttaggatccacagcgtttgtcacaatttatcaagcatccgaaaacatatatgaaacattcgataaagttacagttctttacactggtagacagatatactttggcccaattgatgaagctaaggattacttttacagaatgggttatgaatgtccacctagacaagttacagctgagtttttaactgccttaacagatgtcaatggttaccacaagattaggcctggatacgagaacaaagtcccaagaactgctgaggaatttgaaagatactggcaagagtcccctgagtacagacagcttttgatagatattgaccaatacaaaaaggaaatagatactgaaaagaccaaggaaatatacgaccaatcaatgcaacaagaaaaatctaagcatgctagaaagaagtcttactacactgtttcattctgggaacaaataagactctgtacaaaacgtggtttccaaagaatttatggtgataaagcttacactgttattactatttgctctgcaatcattcaatctctagtctctggttcattatattacaataccccatcatctacttctggtgcattttccagaggtggtgtcctatatttctgtcttttgtactactctttgatgggtttagccaatctgtcttttgagcacagacctattctacagaaacacaaaatctactctttataccatccagcagctgaagcattgggaagtactatcgccaactttccattcagaatgatcggtatgacatgttttctaattattatctacttcctgtctggtctgaacagaactgcatcatcttttttcagagtatacctcttcctaaccatgtgttctgaatcaatcaatgctttatttgaactaatcgccgcaggttgtgacaatatttctcaagctaactctatttctggtattgtaatgatgtcgatttcgctttactctacatatatgattcagttaccttcaatgcgcccatggtttaagtggatttcttatattttacctattagatacgcttttgagtccatgttattagctgaattccacggcagacatatgggttgtggtggtaccctggttccaagtggacctggctatgaaaacattgcatccgaaaaccaagtttgtgcttttgtcggatctaaaccaggccaatcgtgggttttgggtgatgattatctgagactacaattcgaatatgagtacaaacacgaatggagaaactttggtatcatgtggtgcttcttactcggttatattgctctaaaggctcttattactgaaattaaaagaccagtaaaaggtggtggtgatgctttgattttcaagaagggtacaagaaaataccacatgaaacttgatgaagaagacggagaactccatgaaattgataccaaggagaagttttcaagcagaagtggaagttcaacaacctctgaagatgaaatatttgaggaattggagtccaagggtattttcatttggagaaatgtttgttacactattccttacgatggtggtatgcgtcaattattagataacgtttctggtttctgtaaaccgggtacattaactgcattgatgggtgaatctggtgctggtaagacaactcttttgaatacactagctcaaagaaatgttggtatcattactggtgatatgttagtcaatggtaaaccaatcgatatttctttcgaaagaaggactggttacgttcaacaacaagatattcacatatctgaattaactgttagagaatcactacaattttctgctcgtatgcgtcgtgctcaaaatgttcctgaagaggaaaagatggaacacgttgaaagaatcatcaaagttttggacatggaagaatacgctgatgctcttgttggtgatgttggtagaggtctgaatgtcgagcaaagaaagaaattatctatcggtgtcgaactggtcgctaaacctgacctgctacttttcttggatgaacctacttcaggtttggattcacaatcttcatgggctattgtacaactattgaagaaattggctaaggctggccagtctattttgtgtactatccatcaaccttctgccactttgtttgaagaatttgacagattattacttttgaagaagggaggtcaaacagtgtactttggtgatattggtgataactccaaaactcttttgagctactttgagcgcaacggtgcaagaaagtgttctcctagtgaaaatcccgctgaatacatcttagaagccattggtgccggtgctactgcatctgtgaccgaagattggcatcaaatctggaagaattcggatgaatttatttcgactgaaaaggaggtcgatcatttaattgaccaattatcaaatcaaaaaaccgagtcagagtttggcgatgcaccaaccaagtatgctacttcctatgcttaccaattcaaatgggtattgataagaacatctatgagtctttggagaaatttagattacattatgtctaaaatgatgttgatgactgtcggtggtttatatatcggttttacattttatgatccaggtgactcttatactggtttgcaaaataccttatttgctgccttcatttctatcattttatcagctcctgcaatgaaccaaatccaagctcgtgccattgcggctagagagttatttgaggtaagggaatccaaatcgaatatgttccactggtctttgttgttgataactcaatacttaagtgaaattccatatcatttcctattttctgcaatcttcttcgtttcttcttacttcccactgagaactcatttccaggcttccgcatctgccgtatactatctaaactattccatcatgttccaattgtactacataggatttggtctgtgcgttttatacatggctccaaatctgcaatctgcgaatgttattttaggtttatgtttgtctttcctaattgctttctgtggtgttgttcagcccgtttctttaatgccaggcttctggacttttatgtggaaaacttctccttatacctattttgtgcaaaatatggttggtattttgctacataacaaacctgtcatttgtaggaagaaagaactctctatatttgatcccccagctggacaaacttgccaggaattcactcaagcatttttggataaacgtggtggttatattgccaatccaaatgctacaactgcctgtgaatattgtatttacgaagtcggtgatgactacttaaaacacatcagtgctagctacagttatttgtggaggaactttggtctgtattgggcttatattggcttcaacatttgtgccatggttgctatttattacattttccatgtcagaggcgtttcttttaaatttgaccgtgttttcaaattattttcaagaataacgaggagggggaagaagtccaactaa

SEQ ID NO: 134 - protein, 1507 aa, Candida glabrata
MSSSSEISVAGSDVSFEGRLTQHGRHEETPADQLTKILSGRSHEDADGDDAHSDNRSILSRSRRSSTAELSPEMVGRVQSLADVLSRHTSRSGGNIDLSQLSESDRFDAERIIGSFVRDADEQGIHLRKAGVTLEHVSARGADSTAMEGATFGNVLCLPYTIYKAIRDKSGSKMRTILNDVSGLARAGEMVLVLGRPGAGCSSMLKVTAGEIDQFAGGVEGEIMYDGIPQKEMMKRYKPDVIYNGEQDVHFPHLTVQQTLDFAIACKTPSKRVNDVSREEYIASTRDLHATIFGLRHTYHTKVGNDFVRGVSGGERKRVSIAEALVTKGSIYCWDNATRGLDASTALEYAKAIRITTNLLGSTAFVTIYQASENIYETFDKVTVLYTGRQIYFGPIDEAKDYFYRMGYECPPRQVTAEFLTALTDVNGYHKIRPGYENKVPRTAEEFERYWQESPEYRQLLIDIDQYKKEIDTEKTKEIYDQSMQQEKSKHARKKSYYTVSFWEQIRLCTKRGFQRIYGDKAYTVITICSAIIQSLVSGSLYYNTPSSTSGAFSRGGVLYFCLLYYSLMGLANLSFEHRPILQKHKIYSLYHPAAEALGSTIANFPFRMIGMTCFLIIIYFLSGLNRTASSFFRVYLFLTMCSESINALFELIAAGCDNISQANSISGIVMMSISLYSTYMIQLPSMRPWFKWISYILPIRYAFESMLLAEFHGRHMGCGGTLVPSGPGYENIASENQVCAFVGSKPGQSWVLGDDYLRLQFEYEYKHEWRNFGIMWCFLLGYIALKALITEIKRPVKGGGDALIFKKGTRKYHMKLDEEDGELHEIDTKEKFSSRSGSSTTSEDEIFEELESKGIFIWRNVCYTIPYDGGMRQLLDNVSGFCKPGTLTALMGESGAGKTTLLNTLAQRNVGIITGDMLVNGKPIDISFERRTGYVQQQDIHISELTVRESLQFSARMRRAQNVPEEEKMEHVERIIKVLDMEEYADALVGDVGRGLNVEQRKKLSIGVELVAKPDLLLFLDEPTSGLDSQSSWAIVQLLKKLAKAGQSILCTIHQPSATLFEEFDRLLLLKKGGQTVYFGDIGDNSKTLLSYFERNGARKCSPSENPAEYILEAIGAGATASVTEDWHQIWKNSDEFISTEKEVDHLIDQLSNQKTESEFGDAPTKYATSYAYQFKWVLIRTSMSLWRNLDYIMSKMMLMTVGGLYIGFTFYDPGDSYTGLQNTLFAAFISIILSAPAMNQIQARAIAARELFEVRESKSNMFHWSLLLITQYLSEIPYHFLFSAIFFVSSYFPLRTHFQASASAVYYLNYSIMFQLYYIGFGLCVLYMAPNLQSANVILGLCLSFLIAFCGVVQPVSLMPGFWTFMWKTSPYTYFVQNMVGILLHNKPVICRKKELSIFDPPAGQTCQEFTQAFLDKRGGYIANPNATTACEYCIYEVGDDYLKHISASYSYLWRNFGLYWAYIGFNICAMVAIYYIFHVRGVSFKFDRVFKLFSRITRRGKKSN

SEQ ID NO: 135 - DNA, 4503 bp, Saccharomyces bayanus
atgagcagtataaaaaacgcacatggcggctcgaaagatagccccgtaacgagaagctcaagcgcctcatatgcagcttcagaagtttcattttctggcactgcccacggtaaagatgagcagaatgataccctggcacatagacactccaaaacgcttacagggcaggcaatggacagcatgagtcagctcagcgcttccgtgtccaatatgccgccagatgtcgtctccaaagtggagtctctggcggatgcactatctcgtcatacaacaaggagcggcgcctttaacatggattcaggcgatgggttcgatgcgcaagccatctttgaaagcttcgtcagacacgccgatgaacaaggtatccatattcgtaaagccggtgtcaccatagagaacgtgggggcccaaggttccgatgaaagtgctctggagggcgctaccttcggtaacatactgtgtctaccattaactatcatcaaaggtatcaaggcaaagaaacagaaaaaaatgagagacattatacagaacgttaatgcattagcagaagctggtgagatggtcttggtccttgggagaccaggtgccggctgctcttcctttttgaaggttactgctggtgaaattgaccaatttgctggtggcgtcagcggcgatgtagcatatgacggcatcccacaggaggagatgatgaagagatataaagcagatgttatctacaacggtgaattagacgtccatttcccctacctgacggtcaagcaaaccttagattttgctatagcctgcaaaacgcccgcagtaagagtgaataacatttcgagacaggaatatattgaaaatagaagagatctatttgccacaattttcggtctaagacatacttataataccaaggttggtaacgactttgttagaggtgtatccggtggtgaacgtaagcgtgtttccattgcagaagcgttggctgctaagggttctatatactgttgggataatgccaccaggggtctagacgcttctacggctttggaatacgcaaaagcaattcgtatcatgaccaacttgttgaaatctaccgcatttgtcacgatttatcaagcgagtgaaaatatttacgaaacttttgataaggttactgtcctttattccggtagacaaatttactatggtctaattcatgaagcaaagccatatttcgcaaaaatgggttacctgtgtcctccaaggcaagcaactgctgaattcctaactgcgttaacagatccaaacgggtttcataaaatcaagccaggttacgaaaacagagttccaagaactgcaaaagaattcgagacctattggctgaactctccggaatttgttcaattgagaaacgatattgctgcttacaaagccagagttaataccgagaaaacaaaagaaatttatgatgtatcaatggctcaagagaagtctaaatacacaagaaataaatcttactacaccatttcatattgggaacaaatcaggctttgtacacaacgtggattccagagaatttacggtaacaagagttacacagtcatcaatgtttgctccgccatcattcaatcttttattactggttcgttattctataataccccctcatctacttcgggtgcattttcaagaggtggtgttttgtacttcgccctgttgtactactccttgatggggttggcaaatatctctttcgagcatagaccaatcttacaaaaacacaaaggttattctctataccatccttcagccgaggccatcggttccactctagcagctttccccttcagaatgattggtttgacatgtttcttcattattttattcttcttatctggattacatagaacagcaggttccttttttactatctatctgttcctagccatgtgttcagaagcaattaatggtttatttgaaatggtttcctccgtgtgtgactctctttctcaagcaaactctatctcaggtattttgatgatgtccatttccatgtattctacctatatgattcaattaccttcgatgcacccatggttcaaatggatctcttatgtcctgcccattagatatgctttcgaatctatgttgaatgccgaatttcatggtaggcacatggactgtgccgacactttagtacctagtggaggaagctatgatagtttatctgatgactacaaagtttgtgccttcgttggttcaaaagccggccaatcctacgtgcttggtgatgattacttaaaaaatcaattccagtacgtctataaacatacatggagaaacttcggtatcatgtgttgctttttgataggttacattgttttaaaagccgtttttacagagttcaagaggcctgtaaagggtggtggtgacgctcttatattcaaaaaaggatcaaggaaattcatcgcacccgcagacgaggaatcgcctgataatatcaatgacctagatgcaaaggaacaattctccagtgagagtagcggtgccaacgatgatgtttttgaagagctagaagccaagggtgttttcatctggaaggatgtctgctttacgattccgtatgagggtagtacaagaatgcttttggacaatgtctcaggatactgtattccaggtactatgactgccttgatgggtgaatcaggtgctggtaagacaaccttgttgaacaccctcgctcaaagaaatgttggtataatcaccggtgatatgcttgtcaatggtcgccccattgatgcaagttttgaaagacgtacaggttatgtccaacaacaagatattcatattgctgaattgaccgttagggaatcattacaattttctgctcgtatgcgtcgtccacaacatctacctgactctgaaaagatggattatgtagaaaagatcatcagagttttgagtatggaggaatatgctgaggctcttgttggtgaggtgggttgtgggttgaatgttgaacagagaaaaaagttgtctattggtgttgagttggttgctaaaccagatttgctattgttcctcgatgaacctacatcaggtttggattcccaatcctcatggtctattattcaactattgagaaaactatcaaaagctggtcagtccattctttgtacaatccatcagccttcggcgactttattcgaagagtttgacagattattacttctaagaaaaggtggtcaaactgtttattttggagatattggtaaaaattctgctactcttctagaatatttcgaacgcaacggagctagaaaatgtgattctagtgaaaatcctgctgagtatattttagaagccattggtgctggtgctactgcgtccgtcaaggaagattggcatgaaaaatggttaaactctcccgaatgtatacaaacaaaagagaaagtgcaggaattaatcgatgatttgtcgaaacaagaaaatatctcggatgttggaggcgaaccttctaaatatgctacctcttatttttaccagttcaaatatgtcttaatcagaacgtctacctcattctggagaagcttgaactatattatgtcaaagttgatgctaatgttggtcggtggtttatatattggttttactttctacaatgttggtgagagttatgttggtttacaaaatgcgatgtttgcagcatttatttccattattttgtctgcacctgcaatgaatcaaattcaaggccgtgcaatcgcgtccagagaactttttgaagtcagagaatctcaatctaatatgttccattggtccttagtgttgattactcagtacttgagcgaacttccataccatttgctattctcgactattttctttgtttgttcatacttcccattgagaatcttctttgaagcttctaggtccgcagtatactttttgaactattgtatcatgttccagttgtactacgtcggtctcggtttgctagtcttatacatgtcaccaaatctaccatccgctaacgttatcttaggtttatgtttgtcgtttatgatttcattctgtggtgttacgcaacccgtttctttgatgcctggtttctggacttttatgtggaaagcatctccatacacctattttgttcaaaacttggtcggtataatgttgcacaaaaagccagtcgtgtgcaaaaagaaagaactgaactacttcaacccaccaaatggttcaacgtgcggcgagtacatgaaatcatttttagagaaatctactggctacattaaaaatccggacgctacctcagattgtgcatactgtatttatgaggttggtgatagctatttgacgcacatcagctctaaatatagctatctgtggagaaacttcgggatatattggatctacatcttcttcaatatagtcggtatggtttgcgtatactatctcttccatgtgagacaaagttctttcctaagccctaagtttattataaaaaagatcaaaaacataaggaaaagcaaaaaatga

SEQ ID NO: 136 - protein, 1500 aa, Saccharomyces bayanus
MSSIKNAHGGSKDSPVTRSSSASYAASEVSFSGTAHGKDEQNDTLAHRHSKTLTGQAMDSMSQLSASVSNMPPDVVSKVESLADALSRHTTRSGAFNMDSGDGFDAQAIFESFVRHADEQGIHIRKAGVTIENVGAQGSDESALEGATFGNILCLPLTIIKGIKAKKQKKMRDIIQNVNALAEAGEMVLVLGRPGAGCSSFLKVTAGEIDQFAGGVSGDVAYDGIPQEEMMKRYKADVIYNGELDVHFPYLTVKQTLDFAIACKTPAVRVNNISRQEYIENRRDLFATIFGLRHTYNTKVGNDFVRGVSGGERKRVSIAEALAAKGSIYCWDNATRGLDASTALEYAKAIRIMTNLLKSTAFVTIYQASENIYETFDKVTVLYSGRQIYYGLIHEAKPYFAKMGYLCPPRQATAEFLTALTDPNGFHKIKPGYENRVPRTAKEFETYWLNSPEFVQLRNDIAAYKARVNTEKTKEIYDVSMAQEKSKYTRNKSYYTISYWEQIRLCTQRGFQRIYGNKSYTVINVCSAIIQSFITGSLFYNTPSSTSGAFSRGGVLYFALLYYSLMGLANISFEHRPILQKHKGYSLYHPSAEAIGSTLAAFPFRMIGLTCFFIILFFLSGLHRTAGSFFTIYLFLAMCSEAINGLFEMVSSVCDSLSQANSISGILMMSISMYSTYMIQLPSMHPWFKWISYVLPIRYAFESMLNAEFHGRHMDCADTLVPSGGSYDSLSDDYKVCAFVGSKAGQSYVLGDDYLKNQFQYVYKHTWRNFGIMCCFLIGYIVLKAVFTEFKRPVKGGGDALIFKKGSRKFIAPADEESPDNINDLDAKEQFSSESSGANDDVFEELEAKGVFIWKDVCFTIPYEGSTRMLLDNVSGYCIPGTMTALMGESGAGKTTLLNTLAQRNVGIITGDMLVNGRPIDASFERRTGYVQQQDIHIAELTVRESLQFSARMRRPQHLPDSEKMDYVEKIIRVLSMEEYAEALVGEVGCGLNVEQRKKLSIGVELVAKPDLLLFLDEPTSGLDSQSSWSIIQLLRKLSKAGQSILCTIHQPSATLFEEFDRLLLLRKGGQTVYFGDIGKNSATLLEYFERNGARKCDSSENPAEYILEAIGAGATASVKEDWHEKWLNSPECIQTKEKVQELIDDLSKQENISDVGGEPSKYATSYFYQFKYVLIRTSTSFWRSLNYIMSKLMLMLVGGLYIGFTFYNVGESYVGLQNAMFAAFISIILSAPAMNQIQGRAIASRELFEVRESQSNMFHWSLVLITQYLSELPYHLLFSTIFFVCSYFPLRIFFEASRSAVYFLNYCIMFQLYYVGLGLLVLYMSPNLPSANVILGLCLSFMISFCGVTQPVSLMPGFWTFMWKASPYTYFVQNLVGIMLHKKPVVCKKKELNYFNPPNGSTCGEYMKSFLEKSTGYIKNPDATSDCAYCIYEVGDSYLTHISSKYSYLWRNFGIYWIYIFFNIVGMVCVYYLFHVRQSSFLSPKFIIKKIKNIRKSKK

SEQ ID NO: 137 - DNA, 1236 bp, Saccharomyces castelli
aactgtatcggtgctggtgctactgccagtgctgctgctgactggcatgatctatggttagaatctcctgaatgtgctgcagcaagagaagaagttgaagaacttcaccgtgttctcccaagtagaccaacaagtgatgatcctgaattggctggtacctttgctgcttctttcctaactcaaatgaaatgtgtcttgaacagaactaatattcaattttggagatctcctatctatattagagctaagttcttagaatgtgtctcatgtgctttgtttatcggtttatcttatttgaatgtcaaacatactgtcggtggtgctacttctgctttctcttctatgtttatggttttagttattgccttggctatgattaatcaattgcatgtctttgcttatgatagtagagaattatacgaagttagggaagctgcttctaatactttccattggagtgtcttgttactatgtcatatgattgttgaatgtggttggaccatgatctgtcaattctgttgttacatttgttactactggcctgcaggtttcagtggtagagcatctcacgctggtttcttctttttcttctacgttttgattttcccaatgtattttgtttcctacggtttatggattttatacatgtctccagatgttccatctgcttcaatgattaactccaatttattcgcagctatgttattattctgtggtatcttacaaccattagccaaggccccaagattctggatctttatgttccgtttgtctcctctaggttatgttgttcaagctttggtcacacctttggttcataacaagaaggtccgttgtgatgctcatgaattgttagttatggacccaccttccggtcaaaattgtggtgaatatcttgaaacctatattagtaacaatactgggtatttgactaatccaagtgctaccgaaaactgtggttactgtccatacactatccaagatgatgctttagcaagatttgatatcaaatgggtttacagatggagaaactttggtttcatgtgggctttcattatcttcaacattgttgctatgttaggtagttactatattatgagagtcaaggtttggtctttgaaatctgtcttagatttcaagagctggttcaatggtccaagaaaggaaagacatgaaaaagaatccaacattttcaaggcaaccccagctgacgaacaaaaggtcaagaaacaataa

SEQ ID NO: 138 - protein, 411 aa, Saccharomyces castelli
NCIGAGATASAAADWHDLWLESPECAAAREEVEELHRVLPSRPTSDDPELAGTFAASFLTQMKCVLNRTNIQFWRSPIYIRAKFLECVSCALFIGLSYLNVKHTVGGATSAFSSMFMVLVIALAMINQLHVFAYDSRELYEVREAASNTFHWSVLLLCHMIVECGWTMICQFCCYICYYWPAGFSGRASHAGFFFFFYVLIFPMYFVSYGLWILYMSPDVPSASMINSNLFAAMLLFCGILQPLAKAPRFWIFMFRLSPLGYVVQALVTPLVHNKKVRCDAHELLVMDPPSGQNCGEYLETYISNNTGYLTNPSATENCGYCPYTIQDDALARFDIKWVYRWRNFGFMWAFIIFNIVAMLGSYYIMRVKVWSLKSVLDFKSWFNGPRKERHEKESNIFKATPADEQKVKKQ

SEQ ID NO: 139 - DNA, 4461 bp, Zygosaccharomyces rouxii
atggaagtaaaggtagactctgggagtccttcggtctatgaaggttttgaccaagcttcaaaggatcgtgttagagaattagctaaagatctcgagaaacaaagtgtaaaggatgttaatgaggctagtaatggcgaaagtgtcttcggcgttgcaagttcgcaaggtaaagatggtggtgttaatccaatggatgaatctgaatatgacgaaaggttagacccaaattctgatcgttttgaatcgaagtactgggttaaaaacatgtcgaggttgatgaattctgatccggattattataaaccgtattcaatcggatgttgctgggatcaattatctgcgtgcggtgcctcctcagacgttgcatatcagaaaaatgttgccaacttaccgctacagattttacaaacgatttatcggtatgtgagaccatcaagagatgaagatactttccaaattttaaagcaaatggaaggtctaatcaacccaggtgaattgttagtggtgctgggtagaccgggttcaggttgtacgacgttattaaagaccataagttccaatacgcacgggtttcatctttctaaggaatccaatgtatcttacagtggagtaagtcccaaggatataaagaagcattttcgtggtgaagtggtctataatgcagaagctgatattcacttgccacatttaacggtttggcaaacactaattacggtggcacgtctaaagactccaaacaatcgtatcagaggtatagatagagaagtttgggcaaaccatgttgctgatgttgccatggcaacatatggtctttcgcatactagaaacaccagagttggtagtgaactggttagaggtgtttctggtggtgaaagaaagcgtgtttccattgcggaagtttccatttgtggatcgaaatttcaatgttgggataatgccactagaggtttagattccgctactgcattggaattcgttagggctttaaagacccaagcttctctaatggattctgcatcggcggtcgccatttaccaatgttctcaggaagcattcgagcttttcaataaagtgagtgtgctttacgatggatatcagatatttttcggaccttcaggagaagctaaacaatatttcgaagatatgggatatcattgtccctcgaggcagactactgcagattttttaacagctgttacaagtcctgcagaaagaactgttagagaagactataaggagaagggcatagctgtacctcagactgctcatgaaatgagggaacattgggtcaattcacccaattatagaactcttatgcaacaaattgaggaggagaaaaacaaagattcaaatcttggaagccttaaagaagcacatgtagccaagcaggctagaagggcaagaccttcttcaccttatacagtaagttatttccaacaagtgagatatttgctaataagagactggtggagattaattaacagttttgatatcacgtttttccagatatttggtaacgctactatggcgttcatcttaggttccatgttttacaagatcatgaaaaaagattctacagcaactttctattctcgtggtgcttccatgtttttcgcagttcttttcaattccttcacctccatgttggaaatcttttcacttttcgaggcaagaccaatcactgagaagcataggacatactctttataccatccaagtgcagatgcatttgcatctgcattatcagaagtgccgccaagaattttgatttcagtagtcttcaatattgtcttctactttttggtacacttccgcagagatggtggtagattctttttctactatatgatgagtttggtctcttcatttaccatgtcgcacttgtttagaactgtgggttcgttggttaacactttatccgaggccatgattccagcagctatcattctattggccctatcaatgtatacagggtttgctattccagcaacgaaaatgcatggatggtctaaatggatttggtacatcaatccgctgtcttatatctttgaatctttgatggtcaatgagttccacgaccgtaaatttccatgcgctgaatacattccacatggtccctcatacggaaatattggagggaatcaaagagtttgttcagctaatggtgctatcgctggtcgagactatgtcttaggggacgattttctgaaactaagttacaactatcaaaataagcacaaatggcgtggatttggaattggtttggctttcgcgatctttttcttctttgtctacttatttctggtggaatttaatgagggcgctaaacaaaagggtgaaatcttaattttcccacactctgctgtccgtaagatgaagaaacaaagcaaattaaaggatcgtcgtaatgatgatgaggaaagttcgacagcgtctgagttaattactgataaacaattactggcagactcggaggaaacaacttccgatggattaaatgaagctgggttatccaaatcagaagctatctttcactggagaaatctatcttacgacgttcaaatcaagaaggacactaggcgtattttggataatgtggatggttgggttaaacctggaactctaactgcgctcatgggggcatctggtgccggtaagaccactcttttggattgtttagctgaaagagtcacaatgggtgtgattacaggtgacgtatttgtcaatggtaagccccgtgatacctctttccccaggtctattggatactgccaacaacaagatttacatttgactacttccaccgtaagagaatcacttagattttctgcgtatttgcgtcagccatctactgtttctgaacaagaaaaagacgactatgttgaacaagttatcaaaatcttagaaatggaagcctatgcggatgccgttgtcggtgttgcaggagagggtttgaatgtcgaacaaaggaaaagattgacaattggagttgaattagtggctaaaccaaaattgttactatttcttgatgaacctacatctggtttagactctcaaactgcatggtctgtatgccaattaatgaaaaaattagctaaacacggacaagccattctttgtacaatccaccaaccatccgctatcttaatgcaagagttcgatcgtttgttatttatgcaacgtggtggtaaaactgtttattttggtgaccttggtgatggttgtcgaaccatgattgattatttcgaaaagtacggagctcacaaatgtcctagcgatgcgaaccccgctgaatggatgttagaagtcgtgggtgctgcaccaggatcacatgccaatcaagattaccatgaagtgtggaagaattctactgagtatattgcagttcaagaggaattggatcgtatggagaaggaacttccaggagtaagtgatggcgaatccgatgatgaacatcaaaaggcattcgctactagtttatcttaccaatgtttcttggtttcgcaacgtctttttcaacaatactggagaactccagaatacttatgggctaaaatgttcttaacggttgttaaccaattgttcattggatttactttcttcaaggctgatagaagtatgcaaggtcttcagaatcaaatgctgtcagtcttcatgttttgcgttatcttcaatcctattcttcagcagtacttgccctcctttgtgagacaaagagatttatacgaagcaagggaacgtccttcaaggacttattcgtggaaatcatttattgtggcccaaatcatcgtggaagctccttggaatttcatagcaggtacattggccttcttcatctattactatccagttggattttactcaaatgcctccctagctggtcaattgcacgaaagaggtgctcttttctggctgtacagcactgcgttctacgtttacattggttctatgggtctctttgtaatttcattcaatgaagttggcgctaatggggctaatttagcatctctgctctttaccatggctctatcattctgtggtgtcatggcaactcctaaagccatgccacgtttctggatcttcatgtacagagtttctcccttgacatattttatcagtggtgttctttctacgggtatagcaaatgtccctttgaaatgtgcatcttatgaatacgtcaaattctctccaccaagtggacaaacctgtgggaaatacatgtcagactatatcaaagcaacgggaacaggttatttggccgatccgtctgctacaaaaacgtgtgaattctgtcaatactctagtaccaacgatttcttgaagggcattagttcttcctacagtgatagatggagaaactacggtatattcatctgttacattgcattcaattatgccgctgccatctttttatattggttgtcaagagtccctaagacatatggtaaaaagaagaaatag

SEQ ID NO: 140 - protein, 1486 aa, Zygosaccharomyces rouxii
MEVKVDSGSPSVYEGFDQASKDRVRELAKDLEKQSVKDVNEASNGESVFGVASSQGKDGGVNPMDESEYDERLDPNSDRFESKYWVKNMSRLMNSDPDYYKPYSIGCCWDQLSACGASSDVAYQKNVANLPLQILQTIYRYVRPSRDEDTFQILKQMEGLINPGELLVVLGRPGSGCTTLLKTISSNTHGFHLSKESNVSYSGVSPKDIKKHFRGEVVYNAEADIHLPHLTVWQTLITVARLKTPNNRIRGIDREVWANHVADVAMATYGLSHTRNTRVGSELVRGVSGGERKRVSIAEVSICGSKFQCWDNATRGLDSATALEFVRALKTQASLMDSASAVAIYQCSQEAFELFNKVSVLYDGYQIFFGPSGEAKQYFEDMGYHCPSRQTTADFLTAVTSPAERTVREDYKEKGIAVPQTAHEMREHWVNSPNYRTLMQQIEEEKNKDSNLGSLKEAHVAKQARRARPSSPYTVSYFQQVRYLLIRDWWRLINSFDITFFQIFGNATMAFILGSMFYKIMKKDSTATFYSRGASMFFAVLFNSFTSMLEIFSLFEARPITEKHRTYSLYHPSADAFASALSEVPPRILISVVFNIVFYFLVHFRRDGGRFFFYYMMSLVSSFTMSHLFRTVGSLVNTLSEAMIPAAIILLALSMYTGFAIPATKMHGWSKWIWYINPLSYIFESLMVNEFHDRKFPCAEYIPHGPSYGNIGGNQRVCSANGAIAGRDYVLGDDFLKLSYNYQNKHKWRGFGIGLAFAIFFFFVYLFLVEFNEGAKQKGEILIFPHSAVRKMKKQSKLKDRRNDDEESSTASELITDKQLLADSEETTSDGLNEAGLSKSEAIFHWRNLSYDVQIKKDTRRILDNVDGWVKPGTLTALMGASGAGKTTLLDCLAERVTMGVITGDVFVNGKPRDTSFPRSIGYCQQQDLHLTTSTVRESLRFSAYLRQPSTVSEQEKDDYVEQVIKILEMEAYADAVVGVAGEGLNVEQRKRLTIGVELVAKPKLLLFLDEPTSGLDSQTAWSVCQLMKKLAKHGQAILCTIHQPSAILMQEFDRLLFMQRGGKTVYFGDLGDGCRTMIDYFEKYGAHKCPSDANPAEWMLEVVGAAPGSHANQDYHEVWKNSTEYIAVQEELDRMEKELPGVSDGESDDEHQKAFATSLSYQCFLVSQRLFQQYWRTPEYLWAKMFLTVVNQLFIGFTFFKADRSMQGLQNQMLSVFMFCVIFNPILQQYLPSFVRQRDLYEARERPSRTYSWKSFIVAQIIVEAPWNFIAGTLAFFIYYYPVGFYSNASLAGQLHERGALFWLYSTAFYVYIGSMGLFVISFNEVGANGANLASLLFTMALSFCGVMATPKAMPRFWIFMYRVSPLTYFISGVLSTGIANVPLKCASYEYVKFSPPSGQTCGKYMSDYIKATGTGYLADPSATKTCEFCQYSSTNDFLKGISSSYSDRWRNYGIFICYIAFNYAAAIFLYWLSRVPKTYGKKKK

SEQ ID NO: 141 - DNA, 2406 bp, Saccharomyces castelli
atgtcctcctctgaagaaaaggacgtgaattccaaatcacataatgatgacacgaactcatttgctgattcattacaatcattcgaagctggtaatgcagctatcgatgaaaacatgggtgctcattctcaattatcccgtcatttgaccaatatcttatctaatgaagatggtattgaaagattagaatccatggctagaatcatttctacaaagacaaagaaggaaatggatgccttcgaagtcaacgaattagactttgatttgagatctcttttgaactatttgagatctcgtcaactagaacaaggtatcgaacctggtgattcaggtgtcgcattcagaaatttaacatctatcggtgttgatgcctctgccgcctacggtccaagtgtggaagaaatggctagagatatggttaatttccctaaacatttaatgaacatctttaagaagaagggtgacgttccattaagaaatatcattcaaaactgtaccggtgtggtcgaatctggtgaaatgcttttcgtcgtcggtagaccaggtgccggttgttccactttactaaagactatctctggtgaaacttctgatatggtcgaagtccaaggtgatttctcatatgatgggttagatcaagctgaaatgatgagtaaatataaaggttacgtcgtttactgtccagaattagatttccatttcccaaagattaccgttaaggaaactatcgatttcgctttgaaatgtaagacaccacgtactagaattgataatatgtcaagagcagaatatgtggattctctaagagatatgtggtgtactgtcttcggtttaagacatacttatgctactaaggtcggtaacgatttcgttagaggtgtttcaggtggtgaacgtaagcgtgtttctctagtggaagcccaagctatgggtgcctccatctattcatgggataacgctactagaggtttagatgcttctactgctttagaattcgctcaagctatcagaactgctacaaatatgatgaataattctgccattgttgccatttatcaagctggtgaaaatatttatgaattattcgataaggctactgtgttatacaatggtagacaaattttctttggtcctggtgataaagccgttgaatatttcgaaagaatgggttgggttaagccaaatagaatgacatcagctgaattcttaacctcggttactgtggatttcgaaaatagaactttagatattaaaccaggttatgaagataaagtaccaaaatctggtgctgaatttgaaacttactggttgaattctccagaataccaagaagttctaagagaatacgaagattaccatcaaagacattctcctgaggaaactagagatagattggaagttgccaagaaacaaagattacaatcaggtgctcgtgcctcttctcaattcgttgttaactactggtctcaagtttattactgtatgattcgtgggttccaaagagttaaaggtgattccacatatacaaaggtttatctatcttctttcttaattaaaggtttgattgtcggttctatgttccataatattgataataagaaacaatctactaccgctggtgcttactctcgtggtggtttgttattttatgttttgttatttgcctctgttacatccttagctgaaattggtaactcttttgctagtagaccaattatcgttaagcatagatcttattccatgtaccatctttctgctgaatctttacaagaaattatcactgaatttccaactaaatttgttgccgttttaattttgtctttagtcagttattggattcctgtcttgaaatatgaagcaggtgccttcttccaatatatgctttatttgttaactgttcaacaatgtacttctttcattttcaaattcgttgccactactacaactgatggtgtcactgcacatgctattggtggtctttacgttttgattctttgtatctacgccggttttgttttaccaatgggtcaaatgcatcattggattaaatggattcatttcattaatcctttgaattatgctttcgaaagtttaatggctacagaattccacggtagagaaatgttatgttcccagatggtgccaaatggtccaggttacgaaaatgtttccatttcaaatcaaatctgtaactttgttggtgctgttaagggtaacttatatgttagtggtgatacttatattgacaagaacttccatttcggttatgatcatgcttggagaaactggggtattaacgtcgtctggactgccttctacattgtccttaacgttgtcttatctgaatacttgaaacctttatctggtggtggtgatctgttattgtttaagagaggtcatatgcga

SEQ ID NO: 142 - protein, 802 aa, Saccharomyces castelli
MSSSEEKDVNSKSHNDDTNSFADSLQSFEAGNAAIDENMGAHSQLSRHLTNILSNEDGIERLESMARIISTKTKKEMDAFEVNELDFDLRSLLNYLRSRQLEQGIEPGDSGVAFRNLTSIGVDASAAYGPSVEEMARDMVNFPKHLMNIFKKKGDVPLRNIIQNCTGVVESGEMLFVVGRPGAGCSTLLKTISGETSDMVEVQGDFSYDGLDQAEMMSKYKGYVVYCPELDFHFPKITVKETIDFALKCKTPRTRIDNMSRAEYVDSLRDMWCTVFGLRHTYATKVGNDFVRGVSGGERKRVSLVEAQAMGASIYSWDNATRGLDASTALEFAQAIRTATNMMNNSAIVAIYQAGENIYELFDKATVLYNGRQIFFGPGDKAVEYFERMGWVKPNRMTSAEFLTSVTVDFENRTLDIKPGYEDKVPKSGAEFETYWLNSPEYQEVLREYEDYHQRHSPEETRDRLEVAKKQRLQSGARASSQFVVNYWSQVYYCMIRGFQRVKGDSTYTKVYLSSFLIKGLIVGSMFHNIDNKKQSTTAGAYSRGGLLFYVLLFASVTSLAEIGNSFASRPIIVKHRSYSMYHLSAESLQEIITEFPTKFVAVLILSLVSYWIPVLKYEAGAFFQYMLYLLTVQQCTSFIFKFVATTTTDGVTAHAIGGLYVLILCIYAGFVLPMGQMHHWIKWIHFINPLNYAFESLMATEFHGREMLCSQMVPNGPGYENVSISNQICNFVGAVKGNLYVSGDTYIDKNFHFGYDHAWRNWGINVVWTAFYIVLNVVLSEYLKPLSGGGDLLLFKRGHMR

SEQ ID NO: 143 - DNA, 4512 bp, Zygosaccharomyces rouxii
atggataaggggaaagaaataagtggatcaaacgattacgaagtgagtagtcctgatgaaccttatgaaggattggatgaaactgctgcccagagtatcaaggagttggcccattcgttgctcgaagaatcaagggaaagcacacatgctgtcaaggaaggcataaatcctgtttttatggatgaatcgggtgaaaattacaatcctcaattagatccagcaagtgacaagttttcgagtacagaatggattaaaaatatctcggacattgtacattctgatccagacttttacaaaccatacacaattggatgtagttggagaaatttatctgctatcggtgcctcggtcgatgtcgcttatcaaactacagtggataatctaccttggaaattcttgagttgggtttacaggagcctagcgcctacgaaagcgtccaattcttttcaaattctaaaacctatggatgggattgttaaaccaagtgaattgttagttgtgctgggtagacctggttcggggtgtacgactttactaaaatcgatttcgtctaatactcatgggtttaaaattacagaagattctacgatttcatacagtggactttcccccaaggatattaataagcattttagaggtgaagtggtttataaccctgaagctgatattcatttacctcacttgacagtttatgaaactttagttactgttgcgaggttaaagactgcacagaatagaattagaggtgtggatagagagtcgtgggccaggcacataaccgaagttgcaatggcaacctacgggctgtcgcatacgagaaataccaaggtcggtggtgatctagttagaggtgtttctggtggtgaaagaaagcgtgtctccatcgcagaagtgacgatctgtggatccaagttccaatgttgggataatgctactagagggttggatgcggcaacggctctagaattcatcaaggctttaagggcacaggcacaaattgttcaaagtgcggcctgtgttgccatttaccaatgctcccaagacgcatacgacttattcgataaggtatgtgttttgtacagtggttaccaaatctttttcggatctacaggagaggctaaacactattttgagaaaatggggtatcgttgtcctagcagacaaaccactgcagatttcttaacatctattacaagtcctgcggaaagaattgttaatgatgaatatattgagaagggtatacatgtgcctcaaacacctgaagaaatgtcggattactggagaaattcaccggagtaccaaaaacttgtaaaggaagcggatgaatctattaaacaagatcatattgctgctatttcctctattagagaagctcatcgggctagacagtctaagaaagccagatcagcagaaccttataccgtcagttatctcatgcaagtgaagtatttgatgataagaaatatgtggagaattaaaaacagttacagtattactgccttccaaattttcggtaattctgtcatggctcttttgttaggttccatgttttacaaagttatgaaacatccaactaccgatactttctattacagaggtgcggccatgttttttgccattcttttcaatgccttttcatctctactggaaattttctcactgtatgaagctagaccaattactgagaaacatagaacttattctctttaccgcccaagtgcagatgcatttgcctctgtcctgtctgaaattccatcaaagatccttactgccatttttttcaatcttgcattctatttcttggtggattttaggagaaatgctggtagattttttttctatttccttatcaatatcattgcaacttttaccatgtcacacctgtttagatgtgttggttccctaactaacactttaacagaagcaatggttccggcttcaattcttctattgggtatggctatgtacacaggttttgctatcccagagacaaagatgttaggttggtctaaatggatttggtacatcaatccattgtcataccttttcgaagcactgatgaccaatgaatttcatgatcgtaagtttgcttgttctacgtttattccacatggtggggattatgacaatgttacagggaagcaacatatctgtggtgttgtgggtgctataccaggtgaaacctttgtccttggtgataattttttaaagaaaagctacaattatgacattaagcataaatggcgtgcgtttggagttggtatggcatatgtgattttctttttctttgtctatttgttcctatgtgaagttaatcaaggtgctaaacaaaatggtgaaatcctagtgttcccacaaccagtggttaggaagatgcgcaaacaaaagaaaattagtgccagaaattacgattcaaatgacccggaaaaagctatcggtgcaaatgctaatgatttaactgacgcaactttaattaaggattcatctgattcgatggatgaaggacaggaacaaacgggattgactaaatcagaagcaattttccattggagaaatttgtgttacgatgttcagataaagtctgaaacaagacgtattttgaataatgttgacggttgggttaaacctggaacattaaccgccctaatgggctcttcgggtgcaggtaaaacaactttgttggattgtcttgcagaaagagttactatgggtgttatcactggtgacattttcgttaatggtaaattgcgtgatgaatctttccccagatctattggttattgtcaacaacaggatttgcatctaaagacggctaccgttagagaatctttactgttttcagctatgttgcgtcaacctaagagtgttcctgcttctgaaaagagaaagtatgtggaagaagttatcaagattcttgaaatggaaccctatgcagatgcgattgtcggtgtagctggtgaaggcttaaatgttgaacagagaaagagacttacaatcggtgttgaactggtcgctaaacccaaattattggtatttttagatgaacccacatcaggtttggattcccagacggcttggtcgatctgtcagttgatgaaaaaattgtctaaccatggtcaggctattttgtgtaccattcatcaaccttctgccatgttaatgcaagagtttgataggttgttatttctacagaaaggtggtaaaacagtgtactttggtgaacttggtgaaggctgtaaagttatgatcgattattttgaacgtaatggagcaaatccttgtccacccgatgcaaaccctgctgaatggatgcttgaagttgttggtgctgcaccaggtagtcatgctaatcgcgattaccatgaagcttggaagaactctgaagagtataaggttgtccatcaggaattagatcgtttggaaaatgaattgcagggaattgatgatggtgacgatgctgaaaagcataaatcttttgctactgatattttcacacagattcggttggtgagttttcgtctggcacaacaatattggagaagtcccgaatacatatggcctaaatttattgttacaattgtgtgccaactctttgtcgggttcacttttttcaaagctgataaaaccatgcaaggtttacaaaaccagatgttggcggtatttatgttcaccgtcgtttacaacgtccttcttgagcagtacttgcctaattacgtgcaacaaagaaatctttacgaagcaagggaaagaccatcaaggactttttcatggtttgcctttattgtgtctcaaattatagttgaacttccctggaatttcattgcgggcaccgttgcatttttctgttattactaccccattggattttaccgtaatgcatccgagtctcatcaattgcatgaaaggggcgctctattttggttatggtcgaccgcgtactacgtctggattggatctacgggtattttagccaattcattcattgaatatgatgtcactgctgctaatttggcaactttgtgctatactctagctctatctttctgtggtgtgatgactcaaccaaaccaaatgccacgtttctggattttcatgtacagagtttccccgttgacgtatttcattgatgccactctggctattggtgttgctaatgttaacgtggagtgcgcagactacgaatatgtcaggttcagcccacctcaaaataaaacctgtggtcaatacatgcagaaatatatcaaatccgctggtactggttacctagccgatccaagtgctaccgatgaatgcaaattctgtttaatatccaaaactaatgactatttacgaagcgtgagttctacctatcaccacagatggagaaattatggtatcttcatctgttacattgtttttgactatgccggtgcagtgttcctgtactggttggcaagggtaccgaagaattcatggatcaatcgtgttcgcgatagattaatcaagcttacttctagaaaagccaaggactaa

SEQ ID NO: 144 - protein, 1503 aa, Zygosaccharomyces rouxii
MDKGKEISGSNDYEVSSPDEPYEGLDETAAQSIKELAHSLLEESRESTHAVKEGINPVFMDESGENYNPQLDPASDKFSSTEWIKNISDIVHSDPDFYKPYTIGCSWRNLSAIGASVDVAYQTTVDNLPWKFLSWVYRSLAPTKASNSFQILKPMDGIVKPSELLVVLGRPGSGCTTLLKSISSNTHGFKITEDSTISYSGLSPKDINKHFRGEVVYNPEADIHLPHLTVYETLVTVARLKTAQNRIRGVDRESWARHITEVAMATYGLSHTRNTKVGGDLVRGVSGGERKRVSIAEVTICGSKFQCWDNATRGLDAATALEFIKALRAQAQIVQSAACVAIYQCSQDAYDLFDKVCVLYSGYQIFFGSTGEAKHYFEKMGYRCPSRQTTADFLTSITSPAERIVNDEYIEKGIHVPQTPEEMSDYWRNSPEYQKLVKEADESIKQDHIAAISSIREAHRARQSKKARSAEPYTVSYLMQVKYLMIRNMWRIKNSYSITAFQIFGNSVMALLLGSMFYKVMKHPTTDTFYYRGAAMFFAILFNAFSSLLEIFSLYEARPITEKHRTYSLYRPSADAFASVLSEIPSKILTAIFFNLAFYFLVDFRRNAGRFFFYFLINIIATFTMSHLFRCVGSLTNTLTEAMVPASILLLGMAMYTGFAIPETKMLGWSKWIWYINPLSYLFEALMTNEFHDRKFACSTFIPHGGDYDNVTGKQHICGVVGAIPGETFVLGDNFLKKSYNYDIKHKWRAFGVGMAYVIFFFFVYLFLCEVNQGAKQNGEILVFPQPVVRKMRKQKKISARNYDSNDPEKAIGANANDLTDATLIKDSSDSMDEGQEQTGLTKSEAIFHWRNLCYDVQIKSETRRILNNVDGWVKPGTLTALMGSSGAGKTTLLDCLAERVTMGVITGDIFVNGKLRDESFPRSIGYCQQQDLHLKTATVRESLLFSAMLRQPKSVPASEKRKYVEEVIKILEMEPYADAIVGVAGEGLNVEQRKRLTIGVELVAKPKLLVFLDEPTSGLDSQTAWSICQLMKKLSNHGQAILCTIHQPSAMLMQEFDRLLFLQKGGKTVYFGELGEGCKVMIDYFERNGANPCPPDANPAEWMLEVVGAAPGSHANRDYHEAWKNSEEYKVVHQELDRLENELQGIDDGDDAEKHKSFATDIFTQIRLVSFRLAQQYWRSPEYIWPKFIVTIVCQLFVGFTFFKADKTMQGLQNQMLAVFMFTVVYNVLLEQYLPNYVQQRNLYEARERPSRTFSWFAFIVSQIIVELPWNFIAGTVAFFCYYYPIGFYRNASESHQLHERGALFWLWSTAYYVWIGSTGILANSFIEYDVTAANLATLCYTLALSFCGVMTQPNQMPRFWIFMYRVSPLTYFIDATLAIGVANVNVECADYEYVRFSPPQNKTCGQYMQKYIKSAGTGYLADPSATDECKFCLISKTNDYLRSVSSTYHHRWRNYGIFICYIVFDYAGAVFLYWLARVPKNSWINRVRDRLIKLTSRKAKD

SEQ ID NO: 145 - DNA, 4533 bp, Saccharomyces kluyveri
atgtcattcgaagacaatattggagacgacagtattactaaagaaatcccagccatcgaaggtgatgtcgcaccagatcatagaccttactttggcttggaaaatgatctaaaagaacaagagaatattagaaggctagccagatcgttgaccaggcagtcattgcattccgtaagtaataattcattagccgacaatgagaacccaaatgacactaattcggaattcggtttaaaaaggagtttaacaagcatttctcatgttccgggacaggtccctttcagtagtaaggatattgatccaaggttagatcctgagtccgatacgtttgatcctgctttttgggcccaaaacttgagaaagttgtatctgtcagacaaggattactacaagccagttgagttgggtgtctgtttgaagaacatgagagtttctggtgtttccgttgactctgattaccaaagcactgtactcaatttgcctctcaagtggggagagaaactttatacaaatctattcagaagtaatgatgaatctagatatttcgatatcttaaaacctatggatgctttattcgaaccaggaaggctctgtgtcgtacttggtaggccaggcgcaggctgttctacccttttgaaaactatttcagcacgtacctacggttttaaaatccaacctgaatctgtcatttcttatgatggtataacacagaaggaaattacaaaacactacagaggtgatgtcatatattctgctgagatggactaccactttgcttccctgcctgtgggctataccttagaatttgctgcccgttgccgttgccctgaatcaagaccagagggtattaccagagaacaatattacaagcactacgcagcagtcgtaatggctactaatggtttatcccacacgtataacaccaaggtgggtaatgattttatcagaggtgtctctggtggtgaacgtaaaagagtgtccatttcagaagtgacgctagccggtgcaaaagtgcaatgttgggataattctactagaggtctggactctgccactgctttagaattcgttcgtgcattgaaaaccaatgcaaatgtttctagaattaccccattgattgcaatttaccagtgttctcaagacgcgtatgatttatttgacgatgtcttactgctatatgagggctatgaaatttactttggtaaagcggaggatgccaaacagtacttcttagacatgggttgggattgtcctccaaggcaaactacagctgattttttgacatctgtctcatcgcctgctgagaggcgagcaaaacctgaatgggaaaataaggttccaagaactgctaaagaattctacgacatctggttgcactcaaaagaatatgctaaattaaaagttaaaattgataaacatctggctaagtctgaagacggcgagacaaaaagacaactagctgaacatcatagggccagacaatcgaaaaatttaaggccgcagtctccattcataatttcctttggtatgcaggtcaaagccgttattcacagaaacattcaaagaattaagggtgatccttccgtctacctttctgccattatttcaaactctgtcatgggtttacttgtttcttctatgttttacaaccaaaagtccaatacggggagtttttattacagaacttctgctttgtttaccgctattttgtttaactctttctcttcctttttggaaattcttgcgctttttgaagctagaaagattgttgagaaacacaagacatacgccttctatcatccatctgcagatgcgctcgcatctattattactgaactaccatcgaagattctagttgccttgggcttcaatttaagtttctatttcatggttaactttaggagaacaccgggccactttttcttttactttttagtatctgttacttccactttcgccatgtcacacttgttcaggacaattggtgcggcatccacctccttgcaaatggccatgactcctgcctctcttctcttactgatcatcagtatttatgtggggtttgtcattccaaagggtagtctgttaggctggtccaaatggctgtattatttgaatcctattgctagaagcatggaatctatggttgctaatgagtttgcgcatagaacttttgaatgctcacactttattccttcaggcccaggatatgaaaacgtcaccttggccaacaaggtctgtgccgtagtcggttctgtagctggacaaagcacggtggatggtacttcgtacatggagaaatcgttttcctattacgacaaacacagatggagaaattggggtatcgttctatgttatgctgtatttttcttgattgtttatatggttttgattgagtacaacaagggtgaaatgcaaaaaggtgaggttatcctcttcactcgctccaccttgaacaagaaacgtaaaaaaaatgaagccctaaaaggcgatattgaatctaatgactctattactaaagacttgactgtttcggaagagagctattcaaacgaaaaagagaactctctgcaaaaaattggctctgaggatatttttcactggagagatgtttgctacgatgttaagatcaaatcagaaacaagaaggattttgagcaatgttgatggttgggttaaaccaggtactttgactgccttaatgggcagctctggtgctggtaagacaactttactagatgttttagctaatcgtgttagtactggtgtaatcaccggtaacatgtttgtcaatggtcacctgagagatgaatccttccaaaggtccacaggttattgtcagcagcaagacttacacggccgtacgcaaactgtgagagaagctttaaggttttctgcacacttgcgccagcctcaggatgtacctaaggctgaaaaagacgaatacgttgaagaaattattaaacttttagaaatggaagcctattctgatgctttggtaggtgttacgggtgaaggcttaaatgtggaacaaagaaagagactaacaattggtgtggagctggttgctaaaccaaagctattattattcttggatgaaccgacatcgggtttagattcgcagactgcatggtccatttgtcagttaatgcggaagctggctaaccatgggcaagctattttgtgtactattcatcagccttcggctattttgatgcaagaatttgacaggttgttgttgatggctaggggtggtagaaccatttatttcggtgacttgggcgaaggttgtgggaaaatgattgaatactttgaaagcaatgggagcaagaagtttccttctggctgtaacccagcggaatttatgctggaggttataggtgcagcaccaggctctcacactgacgtagactaccacgaagtatggagaaattctaaagagtatcaatccgttcaagaagaattgaagtggatggaaactgaactggccaaggagccgcgcaataattctggagatttgcataaagaatttgctacttctctattgagtcaatactttattgtcaccaatagagttctgcaacagtactggaggactccagcatacatctggtctaaaatcttaactgctgtattctcggctttgttcgttggtttctccttcttcaatgccaaaaaatctatgcaaggtttgcaaaatcagatgttttcattgttcgtgtacattatggtttttaatccgttggttcaacaaatgctaccacagtattgtgaccaaagatctttatatgaagttcgagaaagaccttcgaagacgtactcatggaaagcttttgtacttgcacaagtaagcgcagagttgccatggtgtatctttatcggtaccatatcattcttttgctattactaccctgttggattatacaataatgcgccaaatgatcaacagttacatgagcgtggtgcattgttctggttactatgtgttacgtttttttgcttcatttcgacctttggtctgctgtgtatcgctgccgtggaactatatgagaatgctggtattatagctaatctctgtttcattctttcaattacattttgtggtgtgttggtaactaaggatatgatgcccggattttggaagtttatgtatagagtttctccgatcacctacttgatttcgtcgatgctggcaactgcagttggtaattctgaagtcacgtgctctcctaaagaatacgtccactttgaccctcctagcggtatgagttgtggtgaatatatgaaagactacatcactttgcattctggctacttgctgaatgaggcagccgattctaactgcagcttctgttccttaaaatacacaaacgcgtttttgtctgcatccagtgtttcgtatgaccaaaggtggaggaattggggtatctttttatgttacccagctataaacattattgggtttgttctcttatactggtttttcagggttccaaaatccaagaaggtaggaaaagaaaagaaaacaaactaa

SEQ ID NO: 146 - protein, 1510 aa, Saccharomyces kluyveri
MSFEDNIGDDSITKEIPAIEGDVAPDHRPYFGLENDLKEQENIRRLARSLTRQSLHSVSNNSLADNENPNDTNSEFGLKRSLTSISHVPGQVPFSSKDIDPRLDPESDTFDPAFWAQNLRKLYLSDKDYYKPVELGVCLKNMRVSGVSVDSDYQSTVLNLPLKWGEKLYTNLFRSNDESRYFDILKPMDALFEPGRLCVVLGRPGAGCSTLLKTISARTYGFKIQPESVISYDGITQKEITKHYRGDVIYSAEMDYHFASLPVGYTLEFAARCRCPESRPEGITREQYYKHYAAVVMATNGLSHTYNTKVGNDFIRGVSGGERKRVSISEVTLAGAKVQCWDNSTRGLDSATALEFVRALKTNANVSRITPLIAIYQCSQDAYDLFDDVLLLYEGYEIYFGKAEDAKQYFLDMGWDCPPRQTTADFLTSVSSPAERRAKPEWENKVPRTAKEFYDIWLHSKEYAKLKVKIDKHLAKSEDGETKRQLAEHHRARQSKNLRPQSPFIISFGMQVKAVIHRNIQRIKGDPSVYLSAIISNSVMGLLVSSMFYNQKSNTGSFYYRTSALFTAILFNSFSSFLEILALFEARKIVEKHKTYAFYHPSADALASIITELPSKILVALGFNLSFYFMVNFRRTPGHFFFYFLVSVTSTFAMSHLFRTIGAASTSLQMAMTPASLLLLIISIYVGFVIPKGSLLGWSKWLYYLNPIARSMESMVANEFAHRTFECSHFIPSGPGYENVTLANKVCAVVGSVAGQSTVDGTSYMEKSFSYYDKHRWRNWGIVLCYAVFFLIVYMVLIEYNKGEMQKGEVILFTRSTLNKKRKKNEALKGDIESNDSITKDLTVSEESYSNEKENSLQKIGSEDIFHWRDVCYDVKIKSETRRILSNVDGWVKPGTLTALMGSSGAGKTTLLDVLANRVSTGVITGNMFVNGHLRDESFQRSTGYCQQQDLHGRTQTVREALRFSAHLRQPQDVPKAEKDEYVEEIIKLLEMEAYSDALVGVTGEGLNVEQRKRLTIGVELVAKPKLLLFLDEPTSGLDSQTAWSICQLMRKLANHGQAILCTIHQPSAILMQEFDRLLLMARGGRTIYFGDLGEGCGKMIEYFESNGSKKFPSGCNPAEFMLEVIGAAPGSHTDVDYHEVWRNSKEYQSVQEELKWMETELAKEPRNNSGDLHKEFATSLLSQYFIVTNRVLQQYWRTPAYIWSKILTAVFSALFVGFSFFNAKKSMQGLQNQMFSLFVYIMVFNPLVQQMLPQYCDQRSLYEVRERPSKTYSWKAFVLAQVSAELPWCIFIGTISFFCYYYPVGLYNNAPNDQQLHERGALFWLLCVTFFCFISTFGLLCIAAVELYENAGIIANLCFILSITFCGVLVTKDMMPGFWKFMYRVSPITYLISSMLATAVGNSEVTCSPKEYVHFDPPSGMSCGEYMKDYITLHSGYLLNEAADSNCSFCSLKYTNAFLSASSVSYDQRWRNWGIFLCYPAINIIGFVLLYWFFRVPKSKKVGKEKKTN

SEQ ID NO: 147 - DNA, 4500 bp, Candida glabrata
atgtctcttgcaagtgacaagaaggatgccgatgtggcgtctactactacaactgcgcaagatgatgacaacttgtccacatatcatggtttcgaccatcatgtgcaggaccaagtcagacagcttgcccgcacattgactcaacagagcagtctgcatcaaaagaaagaacacactctgcctgaggaaggtatcaaccctatctttaccaacactgaggccgatgactacaacccaagattggaccctacttccgatgagttctcctctgcagaatgggttcagaacatgagcaacattagcaactcagacccggattactacaaaccatactcccttggctgttactggaaggatttggtcgcaactggtgaatctgctgatatcgaataccaggccaacttcttgaacggaccatataaaggtctgaaaactgtttataacacggtggtgccatccacagcctcttcaaaggacaagaatttcaagattttgaagtctatggaaggtgccgtcaacccaggtgagctgctagttgtgctaggtagacctggttcagggtgtaccactttgctaaaatctatctcgtctaatacccacggtttcaacatcgccaaggaatctactatctcctatagcggcatgactccaaacgacatcagaaaacacttccgtggtgaagttgtctacaacgctgaagccgatatccatttaccacacttgactgtttaccaaactttactgacagttgcaagattaaagactccacaaaaccgtctgaaaggaatcgatagagagacttacgctagacatttaacggaagtggccatggccacttttggtctttcacatacaagaaacaccaaagtcggtaacgacttagttagaggtgtgtctggtggtgaacgtaagcgtgtctccattgctgaagtctctatttgtggttctaaattccaatgttgggataacgcaacgagaggtttagattctgccaccgcactggagtttatccgtgctttaaaagttcaagccagtatttccaacgctgctgctactgtggctatctaccaatgttctcaagatgcatacgatctattcgataaagtctgtgtgctttacgatggttatcaaatttactttggacctgctggtaaggctaaggaatattttcaaaagatgggttacgttagtcctgaaagacagactactgctgacttcctaacagctgtcacttctccatctgaaagaataataaaccaggattacataaatagaggtatctttgttcctcaaactcctaaggaaatgtgggaatattggagagcctccgaagatcatgctgacctaattaaagaaattgacagtaagttatctgataattacgatgctaatcttgcagaaataaaggatgctcatgtcgctagacagtctaagagagctagaccatcttccccatataccgtaagctatggtatgcaaataaaatacttattaattcgtaatttctggagaatcaaacagagttcaggtgttacgttatttatggtcataggtaactcgtcgatggcgtttatattgggttcaatgttctacaaggtaatgaaacataatactacctccacattttatttcagaggtgctgccatgttcttcgctgtcttatttaatgccttctcatccctattggaaattttctctttattcgaagctagaccaatcactgaaaaacatagaacatactcgctataccacccaagtgctgatgcatttgcctctatcctttctgaagttccagctaaacttattactgccgtttgtttcaatattatttactacttcttggtgaatttcagaagaaatggtggtgtcttcttcttctatttcctgatcaacattgttgcagtatttgccatgtctcatttatttagatgtgttggttctgtctcaaagacattatctgctgcgatggttcctgcttccatgttattgcttggtttgtcaatgtattccggttttgcaatcccaaggactaagattttgggatggtctaaatggatctggtacatcaacccacttgcatacttatttgaatcgttgatgatcaatgagttccatgaccgtaaattcccatgttcacaatatatcccatctggttcagtttataataacgttccagctgactcaaggatttgttctagtgttggtgccattagaggtaatgactatgttttgggtgacgacttcttgagagagagttactcttacttgcacaaacataagtggcgtggttttggtattggtctggcctatgtgattttcttccttgttttgtacttaatcctttgtgagtacaatgaaggtgccaaacaaaagggtgaaatcttggtcttcccacaaaatattgttagaagaatgaaaaaagaacgtaaactgaagaatgttagctctgacaatgatgttgaaattggtgatgttagtgatatctccgacaaaaagattcttgctgattcatctgatgaatcggaagaaagtggtgctaacattggtttatctcaatctgaagccatcttccactggagaaacttgtgttacgatgttcaaattaaaaaggaaactagacgtatcttgaataatgtggatggttgggttaaaccaggtactttgactgcgctaatgggtgcatcgggtgctggtaagactacattattggattgtttggcggagagagtaacgatgggtgttattacaggtgaggtttcagttgatggtaagcaaagagatgactcttttgctagatctattggttactgtcaacaacaagatttgcacttgaaaacatcgacagtcagggaatcgctaagattctccgcttacctacgtcaacctgctgatgtgtctattgaagaaaagaaccaatacgttgaagatgtcattaagattctagaaatggaacaatatgcagatgctgttgttggtgttcctggtgaaggtttaaatgttgaacaaagaaagagactgactattggtgttgaattggctgctaaaccaaaacttctggtctttttggatgaacctacttcaggtctggattcacaaacagcatggtccatttgtcaactaatgaagaaactagctaatcatggccaagctattttgtgtacaattcaccaaccttctgctattttgatgcaagagtttgatagattgctgtttttgcaacgtggtggtaagaccgtttactttggtgacctaggtgatggctgtaagactatgatcgattattttgaaagccatggctctcacaagtgtccaccagatgctaacccagctgaatggatgttagaagtcgttggtgctgctccagggtctcatgctaatcaggattaccacgaagtatggagaaattccgatgagtatcaaaaggttcaggaagaattggagtggatgtccaacgagcttccaaagaaaaatactaataactctgagacagtccataaagaatttgctactggtgttctttaccaatgtaagttggtttcccttcgtctgttccaacaatactggagatctccagattacctatggtcaaagttcttcttgactattttcaacaatatctttattggtttcacattcttcaaagctgataggtcattgcaaggtttgcaaaaccaaatgttagctgtttttatgtttacagtgatcttcaacccattgctacagcagtatttgccatcatttgttcaacaaagagacttatacgaagcaagagaaagaccttccagaacattttcatggaaggctttcattgtttctcaaatccttgttgaaatcccatggaatatcctagctggtactgtcgcttttgtgatttactattatgctattgggttctactccaatgcttctgtagcacatcaactacacgaacgtggtgctttgttctggttgttttcgtgcgcattctatgtctacattggatctcttgctctattctgtatttcctttaaccaggtggcagaagcagcagcaaacatggcatccttaatgttcactctatcgctatctttctgtggtgttctagttactccaaatggtatgccaagattctggattttcatgtacagagtatcgccattgacatatctgattgatggtatgctttctactggtgttgctaatgtcgccattaagtgttctaactacgagttactgcggttttctcctgctgcaaacttgacttgtggcgagtacttgggaccatacctacaaaccgtgaagactggctacattgttgacccatcagctacagacacatgtgaactatgtccatactctcataccaatgacttcttgagttctgttagttccaagtactctcgtagatggagaaattggggtattttcatttgttacattgctttcaactatatcgctggtattttcttgtactggttggccagagttccaaagaaatctggtaaacttgccaagaaataa

SEQ ID NO: 148 - protein, 1499 aa, Candida glabrata
MSLASDKKDADVASTTTTAQDDDNLSTYHGFDHHVQDQVRQLARTLTQQSSLHQKKEHTLPEEGINPIFTNTEADDYNPRLDPTSDEFSSAEWVQNMSNISNSDPDYYKPYSLGCYWKDLVATGESADIEYQANFLNGPYKGLKTVYNTVVPSTASSKDKNFKILKSMEGAVNPGELLVVLGRPGSGCTTLLKSISSNTHGFNIAKESTISYSGMTPNDIRKHFRGEVVYNAEADIHLPHLTVYQTLLTVARLKTPQNRLKGIDRETYARHLTEVAMATFGLSHTRNTKVGNDLVRGVSGGERKRVSIAEVSICGSKFQCWDNATRGLDSATALEFIRALKVQASISNAAATVAIYQCSQDAYDLFDKVCVLYDGYQIYFGPAGKAKEYFQKMGYVSPERQTTADFLTAVTSPSERIINQDYINRGIFVPQTPKEMWEYWRASEDHADLIKEIDSKLSDNYDANLAEIKDAHVARQSKRARPSSPYTVSYGMQIKYLLIRNFWRIKQSSGVTLFMVIGNSSMAFILGSMFYKVMKHNTTSTFYFRGAAMFFAVLFNAFSSLLEIFSLFEARPITEKHRTYSLYHPSADAFASILSEVPAKLITAVCFNIIYYFLVNFRRNGGVFFFYFLINIVAVFAMSHLFRCVGSVSKTLSAAMVPASMLLLGLSMYSGFAIPRTKILGWSKWIWYINPLAYLFESLMINEFHDRKFPCSQYIPSGSVYNNVPADSRICSSVGAIRGNDYVLGDDFLRESYSYLHKHKWRGFGIGLAYVIFFLVLYLILCEYNEGAKQKGEILVFPQNIVRRMKKERKLKNVSSDNDVEIGDVSDISDKKILADSSDESEESGANIGLSQSEAIFHWRNLCYDVQIKKETRRILNNVDGWVKPGTLTALMGASGAGKTTLLDCLAERVTMGVITGEVSVDGKQRDDSFARSIGYCQQQDLHLKTSTVRESLRFSAYLRQPADVSIEEKNQYVEDVIKILEMEQYADAVVGVPGEGLNVEQRKRLTIGVELAAKPKLLVFLDEPTSGLDSQTAWSICQLMKKLANHGQAILCTIHQPSAILMQEFDRLLFLQRGGKTVYFGDLGDGCKTMIDYFESHGSHKCPPDANPAEWMLEVVGAAPGSHANQDYHEVWRNSDEYQKVQEELEWMSNELPKKNTNNSETVHKEFATGVLYQCKLVSLRLFQQYWRSPDYLWSKFFLTIFNNIFIGFTFFKADRSLQGLQNQMLAVFMFTVIFNPLLQQYLPSFVQQRDLYEARERPSRTFSWKAFIVSQILVEIPWNILAGTVAFVIYYYAIGFYSNASVAHQLHERGALFWLFSCAFYVYIGSLALFCISFNQVAEAAANMASLMFTLSLSFCGVLVTPNGMPRFWIFMYRVSPLTYLIDGMLSTGVANVAIKCSNYELLRFSPAANLTCGEYLGPYLQTVKTGYIVDPSATDTCELCPYSHTNDFLSSVSSKYSRRWRNWGIFICYIAFNYIAGIFLYWLARVPKKSGKLAKK

SEQ ID NO: 149 - DNA, 4557 bp, Zygosaccharomyces rouxii
atgaaaaaaggaaacgttctcgagacaggttcctcatcacctattgattcaaattcgcccatatcctacgatggcggtagcttggttggtgtcggtcatacagaaggtaacaccggtgcaaatacatctggtttcagtcggggagatatagagagaggtgctaacgatgatgtagaattacatgaaatgttagcgaaatacaaaagtaatggtcaaggttctacatttacaccagaacttgcttctaaagttgaatcattagcaagaacactttcaaaacggaaatcggcagatggaaagtttgatttatcatctgtagatgatgaagatggattcgatgctgaaaaaattctaaggcactttgttaagaatgctagttcacaaggtatcgacttcaggaaaactggtattaccatggaagatgtttcagcaacagggcttgataattcatttttggaaggctcgacgtttgctgatattgcacttttaccttacaccatcttcaaatttctaaaaggtgtaagacatagacgtatgagaaaaattattcgcaatgttaatgcgtttgcactacctggtgaaatggttttggttctaggtagaccaggttccggatgctcatcgtttttaaagacagcagcaggggtgactgaccaatttgcaggtggtgtggaaggtgatattatgtacgatggtgttccacaagatactatgatgaagcactacagaagtgacgttatctacaatggtgagttagatgtccattttccttatcttacagttaagcaaacattggactttgccattgcatgtaaaacaccggctatcagagtcaataacgtctctagaagtgagtacatccgtgaaacccgtgacctatacgcaacgatctttggtttaacccatacctacgatactaaggttggtaacgattttgttcgtggtgtttctggtggtgaaaggaaaagagtttccattgctgaagcgttagcggctagaggtactttttactgctgggataatgctaccagaggtttggatgcgtcaacggcgttagaatatgcaatggcaatccgtatcatgaccaatttgttaaattccacagcgtttgttaccatctatcaagcgagtgaaaacatctatgaaacttttgataaagttacagttttgcacagtggtagacaaatttattatggttcagctagagatgcaaaggcatactttgagaaaatgggctacttgtgtccaccaagacaagcaactgcggaatttttaacctcattgacagatccaaacggtttccacgttgttcgtgaaggttacgaaaataaagtcccacgtacagcagaagacttagaaaattattggttgaattctgaggaatgtgccaacctaaagaaagctattcaagaatacaaagctagtgttgaccctgaagccactaagcagttctttgccgaaaccatgaaagccgaaaaatccaaatatgctagagataaatcttattacaccgtttcatttccggaacaaattagactttgtaccgttagaggattccagaacgtttatggtaataaggcttatactgtgattaacattgccgcagctgtaattcaagcttttattacaggttctgctttttacaattctccagcctcaacagcaggtgctttctctcgtggtggtgttctttattttgccctattgtattactctttgatgggtttggccaacatctcttttgatcacaggcctattctacaaaagcataaaacgtattcattgtatcatcctgcagctgaagccctaggttctactttttctggtgcaccatttagaatgattggtctaacattgttcattattattctgtatttcttagcaggtttgaacagaaccgctgccagtttcttcagagtttattggttccttgctatgtgctctgaagcgatctatgctttattcgatctaattgcatcagcttgtgatgatatttctcaagctaactccattgcaggtttggtcatgtttgccatttcgatgtattctacctatatgatccaattacccaatatgcatccatggttcaaatggatttcatatgttttaccaatcagatatgcatttgaaggtatgcttgagtctgaattccacggtagacacatggcttgtggtaaaggttctttggtaccatcgggtcctggctatgaaaacgtaccagactctgaaagagtttgtgccttcattggatcgaaaaagggtaggtcctgggttttgggtgatgattacttgaatgtccaataccaatacatatactggcatttatggagaaacatcggtattatgttcgcctttttaattggttacaatgtgtttaaagcaattataacagaaatcaaacgtccagtgaaaggtggtggtgatgccttaatctttaagaaaggtaccagaaatgctactgctaagaagaacaatcgccctgatgatttggaatctatggatcaaatgaatgtacaagatgttaaagacaaatactccagcggtagtgatattactcctaacaacgaccaagaaatcgaacagtcctttaaggattttgctagtaaaggtatttttatctggaaaaatatttgttatgtcatcccttacaaaggtggtgaaagaactcttctggataatgttactggttatgtggcaccgggaaccatgacagctttgatgggtgaatcaggtgccggtaaaactactttattaaacactttggctaaacgtgtcaatgttggtgtagtgacaggtgatatgttgattaacggtaaaccagtagatagcagttttgaaagaagaaccggttacgtgcaacaacaagatattcacattgctgaaatgacagttagagaatccttaatcttttcagctcgtttgagaagacctcaaagtattcctgacgcagaaaaagttgcagatgcggaaaccgttatgaagttgttggatatggaagagtatgctgatgccctagttggtggtcttggtgcagggttaaacgtggaacagagaaaaaaattatccattggtgtagaattagtttctaagcccgatctcttacttttcctggatgaacctacctctggtttagattctcaatcttcatgggccattgttcaactgttgaaaagaatttcaagggctggtcaaagtattctttgtaccatccatcagccttccgctacattgtttgaacaatttgacagattattattgttgaagaaaggtggtcaaactgtttattttggtgatatcggtgaaaactcttctattgtgctggactatttcgaaagaaacggtgctagacattgtgaagaaaaggaaaatcctgctgaatacatcttggaggctattggtgcaggtgctactgctactgtcaaagacgactggcacgaaatctggcagaaatctgatgaatatggtgcaacagagcagaaggcttccgaatggattgaaaaattggcaaatcaagaatgtactaatgaagaaattggtagcgcacccaccaaatatgctactgattacttttaccaattcaaatatgtttggttaagaacaaatttgatgttctggagagatgtaccttatattttttcgaaatgtatgttacaggttactgcaggtcttttcatcggttggacctttttcaatcccggtaaaagttatgtcgggttacaagataccatgtttgctgcctttatttccgttattgtcgcagcaccttcaatgaatcaaatccaagcaagagctatatcgtctcgtgaattgtttgaagttcgtgaatccaaatcaaatatgttccattggtcacttttgcttatcacccaatacatggctgaaatcccataccacatattattctcgacctttttcttctgtgcctcttatttcccattgagagtttggttcgaagcatctagatctgccgtctttttcttgaactactgtatcatgttccaattatactacgtcgggttgggtctaacgattctttacatgtcccccaatttaccatctgcaaacgtcatcatgggtttgattctgtccatgatgattcaattctgtggtgtaactcaaccagtgagtttaatgcccggattttggacttttatgtggaaggtttctcccttcacttatttcattcaaaatctggtcgctattgtgctacacaaaaaaccagtcgtttgcaagaagaaagaactcaactatttcgatccacctcaaggtaagacttgcggtgaatatatgaacggttttatgaagcaagctcaaggttacattgcaaatcctgacgcaacttctaattgcgcctactgtcaagtatctgttggtgatgactacatggctcaaagaggcgtttactatggaaatctttggagaaactttggtttctactgggtatacatcgtcttcaacatgttcgccatggttggtatttactacattttctctgtgaggggtgttagtattttcaacccatttgcagtgatcaagagaatcatcaagcgtaaatga

SEQ ID NO: 150 - protein, 1518 aa, Zygosaccharomyces rouxii
MKKGNVLETGSSSPIDSNSPISYDGGSLVGVGHTEGNTGANTSGFSRGDIERGANDDVELHEMLAKYKSNGQGSTFTPELASKVESLARTLSKRKSADGKFDLSSVDDEDGFDAEKILRHFVKNASSQGIDFRKTGITMEDVSATGLDNSFLEGSTFADIALLPYTIFKFLKGVRHRRMRKIIRNVNAFALPGEMVLVLGRPGSGCSSFLKTAAGVTDQFAGGVEGDIMYDGVPQDTMMKHYRSDVIYNGELDVHFPYLTVKQTLDFAIACKTPAIRVNNVSRSEYIRETRDLYATIFGLTHTYDTKVGNDFVRGVSGGERKRVSIAEALAARGTFYCWDNATRGLDASTALEYAMAIRIMTNLLNSTAFVTIYQASENIYETFDKVTVLHSGRQIYYGSARDAKAYFEKMGYLCPPRQATAEFLTSLTDPNGFHVVREGYENKVPRTAEDLENYWLNSEECANLKKAIQEYKASVDPEATKQFFAETMKAEKSKYARDKSYYTVSFPEQIRLCTVRGFQNVYGNKAYTVINIAAAVIQAFITGSAFYNSPASTAGAFSRGGVLYFALLYYSLMGLANISFDHRPILQKHKTYSLYHPAAEALGSTFSGAPFRMIGLTLFIIILYFLAGLNRTAASFFRVYWFLAMCSEAIYALFDLIASACDDISQANSIAGLVMFAISMYSTYMIQLPNMHPWFKWISYVLPIRYAFEGMLESEFHGRHMACGKGSLVPSGPGYENVPDSERVCAFIGSKKGRSWVLGDDYLNVQYQYIYWHLWRNIGIMFAFLIGYNVFKAIITEIKRPVKGGGDALIFKKGTRNATAKKNNRPDDLESMDQMNVQDVKDKYSSGSDITPNNDQEIEQSFKDFASKGIFIWKNICYVIPYKGGERTLLDNVTGYVAPGTMTALMGESGAGKTTLLNTLAKRVNVGVVTGDMLINGKPVDSSFERRTGYVQQQDIHIAEMTVRESLIFSARLRRPQSIPDAEKVADAETVMKLLDMEEYADALVGGLGAGLNVEQRKKLSIGVELVSKPDLLLFLDEPTSGLDSQSSWAIVQLLKRISRAGQSILCTIHQPSATLFEQFDRLLLLKKGGQTVYFGDIGENSSIVLDYFERNGARHCEEKENPAEYILEAIGAGATATVKDDWHEIWQKSDEYGATEQKASEWIEKLANQECTNEEIGSAPTKYATDYFYQFKYVWLRTNLMFWRDVPYIFSKCMLQVTAGLFIGWTFFNPGKSYVGLQDTMFAAFISVIVAAPSMNQIQARAISSRELFEVRESKSNMFHWSLLLITQYMAEIPYHILFSTFFFCASYFPLRVWFEASRSAVFFLNYCIMFQLYYVGLGLTILYMSPNLPSANVIMGLILSMMIQFCGVTQPVSLMPGFWTFMWKVSPFTYFIQNLVAIVLHKKPVVCKKKELNYFDPPQGKTCGEYMNGFMKQAQGYIANPDATSNCAYCQVSVGDDYMAQRGVYYGNLWRNFGFYWVYIVFNMFAMVGIYYIFSVRGVSIFNPFAVIKRIIKRK

SEQ ID NO: 151 - DNA, 4650 bp, Saccharomyces kluyveri
atgtccgagtcaaatcagaactttaactcgaggagttttgaccagggtcaggattctcaagaatcatcttattccctgacgagcgaaaagcattcgttgagaaataagaattcaaacgatgagcacagctctgatggagacgtaaatcgctacacgggttttggccaagacgctaagatgcggattaaggagcttgcaagacaactcactaactcttctttagcaaacttgcagcaagataatgatgatacgggtgcagtttcggaaaccaaatccatatttagtataggtggtacaggaatcaatccagtttataccgatgctggggcacccgggtatgatcccaagctagatccaaactcagaagaattttcatccactgcttgggtcaaaaacatgagttatctaaattccgcagatcctgagtactacaaaccatattcattaggttgtgcttggaagaaccttagagcctacggtgactctaatgatgttgcctatcagtctactgtcaccaacattgtaacgaaacaattcgggtcgttgtatagacgcattagaccgtccaaatctgaagacgtctttgaaattttaaaaccgatggatggtatagttcgctctggtgaacttttagttgttttgggtaggccgggatccggctgctcgacgttgttgaaatccatttcttctaatacgcatggttttaaaatcgacaagacttcgactatttcctacgagggtatgacacctcatgaaattgaaaaacactacagaggtgaagtcgtgtacaatgcagaagcagatgtccatttcccacatttgactgtttttgatactttgaacaccgttgctcgtttagtgactccttctaatcgtataaagggtgttgatagagagtcctttgcaaaacatttgacagaagtttccatggctacttatggtctatcgcacaccagaaataccaaagttggtagtgaattggtgagaggtgtatctggtggtgagcgtaagagagtttctattgccgaagtctccatttgtggatccaagtttcaatgttgggataatgccactagagggttggactctgctactgctttggaatttattcgtgctttaaagactaatgcgactatctcggataccgctgcagtgattgcgatttaccaatgttcccaagacgcttatgatcttttcgataaagtgtgtgttcttcacgaaggttatcaaatcttttacgggcctacgagagaagctaaaaagtactttgaggatatgggttatgtttgtccgtctagacagaccactgctgactttttgacagcagtgaccaacccgagtgaaagagtcgcaaatgaagattttatcagaaatggtaagaaaattccttctactgccaaggagatggaagcccactggaaaaattctgaaaattacaggagattggtgagtgaaattgacgctcaactgagcagcaatacggaaacttctcgtcagcaggtgaaagaagcacacaatgctaaacagtctaaacgtactagacccagctcgccttatacagtcagctatggtatgcaagtgaaatacttgcttattcgtagttttcaaagaatcagaaacaatatgggtatcaccttgttccaagttattgctaattctgtgatggcattgatcttaagttccatgttttataaagtcatgttatcgaacacgacatccacattctactcccgtggcgctgctatgttttttgcggttttgtttaacgccttttcatctctattggaaattttctccttgtatgaagctagaccaatcactgaaaaacataaacgttactccttgtatcatccatccgctgaagctttggcgtcagtcatctccgagatacctgccaaaattgccacatcaatttttttcaacatcattttttactttatggtcaactttaaaagaaacgctggcgcatttttcttctattacatgatgaatttaatcgctacctttacgatgtctcatatattcagatgtcttggctctgctaccaagactctttcagaagcaatggttcctgcctctattattttgttggctttatccatgtacgttgggtttgccattccgaaaactaagatgttaggttggtccaaatggatctcgtatatcaacccattatcctacatttttgagtccttgatgataaacgaattccatagccgtcattttgaatgtgctcaattcattccatctggtcctgcttacattaatgctagcggtgctgaacgtgtctgttcggcagtgggttctcagcctggcctttctttcgtcagtggtgacgattatttaagagagagctatcgttatgagcataaacacaaatggcgtggatttggtattggtattgggtatgtcatctttttcttggcagtctaccttatcttctgtgagtttaacgaaagtgcaaagcaacgtggtgaaattttggttttcaccaaatctactttgagaaagatgaagaaggagaaaaagttgaaatctggtgctgctccagccgatgatgtagagaattcagccggtaccgaaaatgcaaatgataaaaaactattggaagactcttttgaggagtctgcttccagtgatgaaattggtatttcaaagtctgaagctatatatcattggaagaacttgtgttatgaagttcaaatcaaggatgaaactaggcgtattttgaactgtgttgatggttgggtcaagccaggtaccttgacagcgctaatgggtgcttctggtgcgggtaaaactacattattggattgtttagcctccagagttactatgggtacgattaccggtgacatgtttgtcaatggtcacttgcgtgactcttcgtttcctagatctattggttactgtcaacaacaagatttacacttggaaactgctaccgttagagaatctttaaggttttctgcccatctacgtcgaccagcttctgtgtctgttgaggaaaagaataaatacgtcgaagaagttatcaaagtcttggaaatggaaaaatatgcggatgcagtcgttggtgttgctggtgaagggctgaacgttgaacaaagaaaaaggttgacaatcggtgtggagttggctgctaagcctaagctattgttgtttttggatgaacctacctccggtttagactctcaaacagcttggtcgatttgtcaattaatgagaaaattggccaaccacggacaggctattttgtgtacgattcatcaaccttcagcgttgttgatgcaagaatttgacagattattatttttacaacgtggtggtaggactgtttactttggagacttgggtgatggttgtcaaactatgattgattatttcgaaagacacggtgcacacaaatgcccacaaggtgccaatccagctgagtggatgttagaagtcattggagcagcaccaggatcccatgccaaacaagactaccatgaagtgtggagaaattcggaagagtataccgctgttcaagaggaattattatcgatggagagagaactgattcatagacctttagacaataccgaagaacaaacagaattcgcatcgtcgccatggtatcaatactctctggtcactaagcgtttgttccaacaatattggagaacgccttcttatttgtggtccaaaattattttgacattggtttctcaaatttttatcggtttcacttttttcaaggcagacacttctatgcaaggattacaaaatcagatgctatcggttttcatgttcactgttatatttaatcctacgttgcaacagtacttgccgaattacgttgcacaaagaaatctatatgaagccagagagcgtccctccagaactttttcgtggaaagctttcatgttgtcgcaaatcactgtggaaattccatggaactttgccgttggaacacttgcctttttcatttactactatccagttggtttttaccacaacgcttcgtttgccggtcagttaaatgaaagaggtgcccttttctggttgttttccactgcattctacatttacatcggctctaccggccagatggttgttgccggtatggaggttgccgaaggtgcaggtaatattgcttccttgttattcacaatgtctttgtccttttgtggtgtgatggctacaccatctcaaatgccacgtttctggatattcatgtacagagtctcgccactaacttactttattgacggtgttctatctactggtattgcgaacgccctgattaagtgttctgactacgagttacttcatttcgctccgccaagtggcaaaacttgcggtgagtatatgaccccttacttggaaatggttggtactggttacttgacagattcagaatctactagtgcctgttctttctgccccgtttcttataccaacgactacttgtcccaggtcagttcctcttatagcagaagatggagaaattacggtattttcatctgttacatttttatcaactattttggggccatatttctatactggcttgcaagggttccaaagaaaagtaatagagttcttaatgaacgtggcacagagaaggaagcgaagcagttacctaatgataaggctacagtttag

SEQ ID NO: 152 - protein, 1549 aa, Saccharomyces kluyveri
MSESNQNFNSRSFDQGQDSQESSYSLTSEKHSLRNKNSNDEHSSDGDVNRYTGFGQDAKMRIKELARQLTNSSLANLQQDNDDTGAVSETKSIFSIGGTGINPVYTDAGAPGYDPKLDPNSEEFSSTAWVKNMSYLNSADPEYYKPYSLGCAWKNLRAYGDSNDVAYQSTVTNIVTKQFGSLYRRIRPSKSEDVFEILKPMDGIVRSGELLVVLGRPGSGCSTLLKSISSNTHGFKIDKTSTISYEGMTPHEIEKHYRGEVVYNAEADVHFPHLTVFDTLNTVARLVTPSNRIKGVDRESFAKHLTEVSMATYGLSHTRNTKVGSELVRGVSGGERKRVSIAEVSICGSKFQCWDNATRGLDSATALEFIRALKTNATISDTAAVIAIYQCSQDAYDLFDKVCVLHEGYQIFYGPTREAKKYFEDMGYVCPSRQTTADFLTAVTNPSERVANEDFIRNGKKIPSTAKEMEAHWKNSENYRRLVSEIDAQLSSNTETSRQQVKEAHNAKQSKRTRPSSPYTVSYGMQVKYLLIRSFQRIRNNMGITLFQVIANSVMALILSSMFYKVMLSNTTSTFYSRGAAMFFAVLFNAFSSLLEIFSLYEARPITEKHKRYSLYHPSAEALASVISEIPAKIATSIFFNIIFYFMVNFKRNAGAFFFYYMMNLIATFTMSHIFRCLGSATKTLSEAMVPASIILLALSMYVGFAIPKTKMLGWSKWISYINPLSYIFESLMINEFHSRHFECAQFIPSGPAYINASGAERVCSAVGSQPGLSFVSGDDYLRESYRYEHKHKWRGFGIGIGYVIFFLAVYLIFCEFNESAKQRGEILVFTKSTLRKMKKEKKLKSGAAPADDVENSAGTENANDKKLLEDSFEESASSDEIGISKSEAIYHWKNLCYEVQIKDETRRILNCVDGWVKPGTLTALMGASGAGKTTLLDCLASRVTMGTITGDMFVNGHLRDSSFPRSIGYCQQQDLHLETATVRESLRFSAHLRRPASVSVEEKNKYVEEVIKVLEMEKYADAVVGVAGEGLNVEQRKRLTIGVELAAKPKLLLFLDEPTSGLDSQTAWSICQLMRKLANHGQAILCTIHQPSALLMQEFDRLLFLQRGGRTVYFGDLGDGCQTMIDYFERHGAHKCPQGANPAEWMLEVIGAAPGSHAKQDYHEVWRNSEEYTAVQEELLSMERELIHRPLDNTEEQTEFASSPWYQYSLVTKRLFQQYWRTPSYLWSKIILTLVSQIFIGFTFFKADTSMQGLQNQMLSVFMFTVIFNPTLQQYLPNYVAQRNLYEARERPSRTFSWKAFMLSQITVEIPWNFAVGTLAFFIYYYPVGFYHNASFAGQLNERGALFWLFSTAFYIYIGSTGQMVVAGMEVAEGAGNIASLLFTMSLSFCGVMATPSQMPRFWIFMYRVSPLTYFIDGVLSTGIANALIKCSDYELLHFAPPSGKTCGEYMTPYLEMVGTGYLTDSESTSACSFCPVSYTNDYLSQVSSSYSRRWRNYGIFICYIFINYFGAIFLYWLARVPKKSNRVLNERGTEKEAKQLPNDKATV

SEQ ID NO: 153 - DNA, 4536 bp, Saccharomyces cerevisiae
atgcccgaggccaagcttaacaataacgtcaacgacgttactagctactcctccgcgtcttcttctactgaaaacgctgctgatctacacaattataatgggttcgatgagcatacagaagctcgaatccaaaaactggcaaggactctgaccgcacagagtatgcaaaactccactcaatcggcacccaacaaaagtgatgctcagtctatattttctagcggtgtggaaggtgtaaacccgatattctctgatcctgaagctccaggctatgacccaaaattggaccccaactccgaaaatttttctagtgccgcctgggttaagaatatggctcacctaagtgcggcagaccctgacttttataagccttattccttaggttgcgcttggaagaacttaagtgcttctggtgcttccgcagatgtcgcctatcagtcaactgtggttaatattccatacaaaatcctaaaaagtgggctgagaaagtttcaacgttctaaagaaaccaatactttccaaatcttgaaaccaatggatggttgcctaaacccaggtgaattgctagtcgttttaggtagaccaggctctggctgtactactttattaaaatccatctcttcaaatactcatggttttgatcttggtgcagatactaaaatttcttacagcggctactcaggtgatgatattaagaaacattttcgtggtgaagttgtttacaacgcagaagctgatgtacatctgcctcatttaacagtcttcgaaactttggttacagtagcgaggttgaaaaccccacagaaccgtatcaagggtgtcgatagggaaagttatgcgaatcatttggcggaagtagcaatggcaacgtacggtttatcgcatacaaggaatacaaaagttggtaacgacatcgtcagaggtgtttccggtggtgaaaggaagcgtgtctccattgctgaagtctccatctgtggatccaaatttcaatgctgggataatgctacaaggggtttggattccgctaccgctttggaatttattcgtgccttaaagactcaagctgatatttccaatacatctgccacagtggccatctatcaatgttctcaagatgcgtacgacttgttcaataaagtctgtgttttggatgatggttatcagatctactatggccccgccgataaggccaagaagtactttgaagatatggggtatgtttgtccaagcagacaaaccaccgcagattttttgacctcagttacaagtccctctgagagaaccctgaacaaagatatgctaaaaaaaggtattcatataccacagaccccgaaggaaatgaacgattactgggtaaaatctccaaattacaaagagctaatgaaagaagtcgaccaacgattattgaatgacgatgaagcaagccgtgaagctattaaggaagcccacattgctaagcagtccaagagagcaagaccttcctctccttatactgtcagctacatgatgcaagttaaatacctattaatcagaaatatgtggagactgcgaaataatatcgggtttacattatttatgattttgggtaactgtagtatggctttaatcttgggttcaatgtttttcaagatcatgaaaaagggtgatacttctacattctatttccgtggttctgctatgttttttgcaattctattcaatgcattttcttctctgttagaaatcttttcgttatatgaggccagaccaatcactgaaaaacatagaacatattcgttataccatccaagtgctgacgcttttgcatcagttctatcagaaataccctcaaagttaatcatcgctgtttgcttcaatataatcttctatttcttagtagactttagaagaaatggtggtgtattctttttctacttattaataaacattgtcgcggttttctccatgtctcacttgtttagatgtgttggttccttaacaaagacattgtcagaagctatggttcccgcttctatgttattgttggctctatccatgtataccggttttgctattcctaagaagaagatcctacgttggtctaaatggatttggtatatcaatccgttggcttacttattcgaatctttgttaattaacgagtttcatggtataaaattcccctgcgctgaatatgttcctcgtggtcctgcgtatgcaaacatttctagtacagaatctgtttgtaccgtggttggagctgttccaggccaagactatgttctgggtgatgatttcattagaggaacttatcaatactaccacaaagacaaatggcgtggtttcggtattggtatggcttatgtcgtcttctttttctttgtctatctattcttatgtgaatacaacgagggtgctaaacaaaaaggtgaaatattagttttcccacgcagtatagttaaaagaatgaagaaaagaggtgtactaactgaaaagaatgcaaatgaccccgaaaacgttggggaacgtagtgacttatccagcgataggaaaatgctacaagaaagctctgaagaggaatccgatacttacggagaaattggtttatccaagtcagaggctatatttcactggagaaacctttgttacgaagttcagattaaggccgaaacaagacgtattttgaacaatgttgatggttgggttaaaccaggtactttaacagctttaatgggtgcttcaggtgctggtaaaaccacacttctggattgtttggccgaaagggttaccatgggtgttataactggtgatatcttggtcaatggtattccccgtgataaatctttcccaagatccattggttattgtcagcaacaagatttgcatttgaaaactgccactgtgagggagtcattgagattttctgcttacctacgtcaaccagctgaagtttccattgaagaaaagaacagatatgttgaagaagttattaaaattcttgaaatggaaaaatatgctgatgctgttgttggtgttgctggtgaaggtttaaacgttgaacaaagaaaaagattaaccattggtgttgaattaactgccaaaccaaaactgttggtctttttagatgaacctacttctggtttggattctcaaactgcttggtctatttgtcagctaatgaaaaagttggcaaatcatggtcaagcaattctatgtactattcaccaaccctctgctattttgatgcaagaattcgatcgtttactatttatgcaacgtggtggtaagactgtctactttggcgacttgggcgaaggttgtaaaactatgatcgattattttgaaagccatggtgctcataaatgccctgctgacgccaacccagctgaatggatgctagaagttgttggtgcagctccaggctctcatgcaaatcaagattattacgaagtttggaggaattctgaagagtacagggccgttcaatctgaattagattggatggaaagagaattaccaaagaaaggttcgataactgcagctgaggacaaacacgaattttcacaatcaattatttatcaaacaaaattggtcagtattcgtctattccagcaatattggagatctccagattatttatggtcgaagtttattttaactattttcaatcaattgttcatcggtttcactttcttcaaagcaggaacctcgctacagggtttacaaaatcaaatgttggctgtgttcatgtttacggttattttcaatcctattctacaacaatacctaccatcttttgtccagcaaagagatttgtatgaggccagggaacgcccctcaaggactttttcttggatttcatttatcttcgctcaaatattcgtggaagttccatggaatatattggcaggtactattgcttattttatctactattatccaattggattttactccaacgcgtctgcagctggccagttgcatgaaaggggtgctttattttggttgttctcttgtgctttctacgtttatgttggttctatgggtctgcttgtcatttcattcaaccaagttgcagaaagtgcagctaacttagcctctttgttgtttacaatgtctttgtctttttgtggtgttatgactaccccaagtgccatgcctagattttggatattcatgtacagggtttcacctttgacttatttcattcaggctctgttggctgttggtgttgctaacgtagacgtcaaatgcgctgattacgaattgctagaattcacaccaccatccggtatgacatgtgggcagtacatggaaccatatttacaactagcaaagactggttacttaactgatgaaaatgccactgacacctgtagtttctgtcaaatatctacaaccaatgattacttagctaatgtcaattctttctacagtgagagatggagaaattatggtatcttcatctgttatattgcattcaattatatcgctggtgtctttttctactggttagcaagagtgcctaaaaagaacggtaaactctccaagaaataa

SEQ ID NO: 154 - protein, 1511 aa, Saccharomyces cerevisiae
MPEAKLNNNVNDVTSYSSASSSTENAADLHNYNGFDEHTEARIQKLARTLTAQSMQNSTQSAPNKSDAQSIFSSGVEGVNPIFSDPEAPGYDPKLDPNSENFSSAAWVKNMAHLSAADPDFYKPYSLGCAWKNLSASGASADVAYQSTVVNIPYKILKSGLRKFQRSKETNTFQILKPMDGCLNPGELLVVLGRPGSGCTTLLKSISSNTHGFDLGADTKISYSGYSGDDIKKHFRGEVVYNAEADVHLPHLTVFETLVTVARLKTPQNRIKGVDRESYANHLAEVAMATYGLSHTRNTKVGNDIVRGVSGGERKRVSIAEVSICGSKFQCWDNATRGLDSATALEFIRALKTQADISNTSATVAIYQCSQDAYDLFNKVCVLDDGYQIYYGPADKAKKYFEDMGYVCPSRQTTADFLTSVTSPSERTLNKDMLKKGIHIPQTPKEMNDYWVKSPNYKELMKEVDQRLLNDDEASREAIKEAHIAKQSKRARPSSPYTVSYMMQVKYLLIRNMWRLRNNIGFTLFMILGNCSMALILGSMFFKIMKKGDTSTFYFRGSAMFFAILFNAFSSLLEIFSLYEARPITEKHRTYSLYHPSADAFASVLSEIPSKLIIAVCFNIIFYFLVDFRRNGGVFFFYLLINIVAVFSMSHLFRCVGSLTKTLSEAMVPASMLLLALSMYTGFAIPKKKILRWSKWIWYINPLAYLFESLLINEFHGIKFPCAEYVPRGPAYANISSTESVCTVVGAVPGQDYVLGDDFIRGTYQYYHKDKWRGFGIGMAYVVFFFFVYLFLCEYNEGAKQKGEILVFPRSIVKRMKKRGVLTEKNANDPENVGERSDLSSDRKMLQESSEEESDTYGEIGLSKSEAIFHWRNLCYEVQIKAETRRILNNVDGWVKPGTLTALMGASGAGKTTLLDCLAERVTMGVITGDILVNGIPRDKSFPRSIGYCQQQDLHLKTATVRESLRFSAYLRQPAEVSIEEKNRYVEEVIKILEMEKYADAVVGVAGEGLNVEQRKRLTIGVELTAKPKLLVFLDEPTSGLDSQTAWSICQLMKKLANHGQAILCTIHQPSAILMQEFDRLLFMQRGGKTVYFGDLGEGCKTMIDYFESHGAHKCPADANPAEWMLEVVGAAPGSHANQDYYEVWRNSEEYRAVQSELDWMERELPKKGSITAAEDKHEFSQSIIYQTKLVSIRLFQQYWRSPDYLWSKFILTIFNQLFIGFTFFKAGTSLQGLQNQMLAVFMFTVIFNPILQQYLPSFVQQRDLYEARERPSRTFSWISFIFAQIFVEVPWNILAGTIAYFIYYYPIGFYSNASAAGQLHERGALFWLFSCAFYVYVGSMGLLVISFNQVAESAANLASLLFTMSLSFCGVMTTPSAMPRFWIFMYRVSPLTYFIQALLAVGVANVDVKCADYELLEFTPPSGMTCGQYMEPYLQLAKTGYLTDENATDTCSFCQISTTNDYLANVNSFYSERWRNYGIFICYIAFNYIAGVFFYWLARVPKKNGKLSKK

SEQ ID NO: 155 - DNA, 4500 bp, Kluyveromyces thermotolerans
atgagcgcagacgtgcaggctaagtccggcgcagagccaaggtcgggcgcagcatcgagccgcagcgaggcggagcacgaggccgcgtacacagggcccgggaccaaggaggaattccaggacgcgcggcagagcgatggccaggcggcaagagaccacattgtgcgcctgatggcacgcagaaccagctccgtcggcgaagaggaggacctcgacccagaggttctgtcgcgcgtggagacactggcgcgcacgctttccagccacaggatgcggaacggcgtgctgcaggttgaccccgatgacttcgacgcagaggctatcatccgcgcgcacgtgcgcggcagcgaggagcagggcatccacctgcgtcgcgcaggcgtaatcggtgagaacttcaccgtagtaggcaaggactgctcttcagtcgaggcacagacattcgaagatatactgctgttgccccggaccatcttccgtggcatccgcgaggctaagaaccgcaagaccagagacattgtgagaaatgccaacatactcgcacggcccggggaaatgatcctggtgctcggcagacccggcgctggctgctcgtcctttttaaagacggtctcaggtgaggttgacaacttcgaagaggtgcgcggagaaatcagctacgacgggatttcccagaaggaaatgatggccaagttcaaaaccgacgtgatctacaacggcgagaccgacgtgcacttcccgcacttgacggtccagcaaacactcgactttgcgctttcgtgcaccacgccgcagaagaggctggacaacgcgtccaggtccgaatacatcaccgccatgcgcgagctctacggtaccattttcggtctgaggcacacctacaacaccaaggtcggaaacgactttgtcagaggtgtttctggtggtgagcgtaagcgtgtttccatcgccgaagcactcgcttcaaggggttctatctactgttgggacaacgcgaccagaggtcttgacgcctccactgccttggaattcgcccaagccatcagaatcatgaccaacctccagaagtctgtcgcgttcgtcacaatctaccaggccagtgaaaacatctacgaatgtttcgacaaagtcactgtcctgtttgatggtagacagatctattacggccacgtagaggatgccaaggcatacttcaagaaattgggtttcttgtgcccagcgagacaggcctccgcagagtttctcacagcactaacagaccccaacggtctccatgaatacgtgccagggtttgagaacaaagttcccagaaccgcagatgagtttgagaagctgtggctagagtctcaagaataccaggaccttctcaaggacattgacaactacaaaagagaaacagaagcagaaaaaacaaaggaactcttttcagcatctctggcccaagagaaatccaaattaaatcgcaaaaagtccaaatacactgtatcttttgccgaacaagtcaagctttgtaccaagcgtggcgtccaaaggatatacggtgataaagcatacaccatcaccaacttgattgcctcgatcattcaaagtttggtgtctggttccctgtattacaacttaccctccggtgtatcaggcgcattttcaagaggtggtgtcttctatttctctatcttgtatgtctccttgatggggcttgcaaaaatcagtttagatggcagacctgtcgttcagaaacacaagtcatactctctataccatccagcggcagaagcgcttgcaacttcactttcggaatttccatttagatttttgagtcaaacatgcttctacattatcatctacttcctttctggcctgacaagagaagcgaacagattcttcacctctttcctgttcctcattttatgttctgagtccatcaatgccttctttgagttgattacagctttcagttcatcggttgctcaggctaattcgattgcaggtaccagtcttatggcgctggttctgtactcaacctacatgatccaactagagtccatgcacccctggttcaaatggatttcatattgtattcctatcagatacacatttgaaagtatgctgaattcggagttccacgccagaaagatggactgcacgggaagtatcatccccgctggtcctgcttacgctaacgtagccactgaaaaccaggtttgtgcttttgtgggctcgaagccgggccaagattacgttaatggcgatgattacattaaggccaattatggctacaagtatgatcatacctggagaaacctaggatttctgttcgctttcttggcggtttatgtcgctttaaagtgtttgattacagaattgaacactacatcgatgggatcgggcgatacattagtgttcaagaagggggcaaagagagttagtccctcgtcagatgaggaaagtagagagaaatcgctcactatgtccgaggcgaagaaaaacttggactctaatgcctccactagcggtagctctgccgaggctcttcagggactaaaaagtacgggaatctttatctggagaaacgtttgttacactatcccttacaggggttcaacccgtcggctgctggacaacgtgagcggttactgtgcgccggggacattaacagcactaatgggtgagtcaggcgcgggtaaaacaaccttgttgaatactttggctcaaaggaacgttggtatcatcacaggtgacatgcttgtgaacggtaatcacattgacgctagtttcgaaagacgcacgggttatgttcagcagcaggatgtgcatgtcaaagagatgacagtcagagagtctctacagtttgcagctaggatgcgtagacctcagtctgtccctgaagcggagaaaatggcatacgtcgaagatataattgaaattttggatatggaggaatacgcagacgcgcttgtcggtgacgttggatacggtctcaatgtcgagcaaagaaagaaggtatccattggtgtcgagttggccgccaagcctgatttactgctgttcttggatgagccaacttccggtcttgattcgcagtcatcatgggctattgtgcaattgatgagaagactagcggaagccggtcaatctattctatgcacaatccaccaaccttctgctacccttttcgagcagtttgacagacttctattgttaaagaaaggcggacagaccgtatattttggtcctatcgggaaaaactctcgtaccttgctaaattacttcgagggaaatggcgcacgcaaatgtgaacacacagaaaatcctgctgagtacatcttggaagctatcggtgcaggtgctacggcatccgtgaaggaagactggcatgaaatttggacaaactcccctcagttcaacgaggctaatgaagaaattgaaaactatctcagagactcaaaacaaaactccccaccggccgataagaatgagaagatctccaaatatgcgacatcttactcttatcagttcagatatgtgcttcaaagaacagccaccatattctggagaaattctgaatatttgattgctaaaatgatgctttacattagcgctggtttgtttattggttttaccttctacaatgtaggaacaagttaccgtggtctgcagaacactatgtttgctgctttcatggctttgatcgtgtcagcaccagctatgaaccaaattcaagctcgtgctattgcatcgcgtgaattgtttgaggtcagggagtcaaaatcgaacacattccactggatatttttgttgcttacccagtacctgtgtgagatcccttaccatctcgtgttctcgacactatttttcgtggcgttctatttcccacttagggttcactttgctgcaacctattccggcgttttcttcttgaactactgtatcatgttccagctctatcttgtgggactaggtttaatgctgctgtatgctgctccaaacttgccttccgctggtgttttactgagtttgtgtttgtcctttttgatttctttctgcggtgttgtacaacctgcaagtctaatgccgggtttttggacctttatgtggaaagcgtctccctacacctactttgtgcaaaacgcaattagtttagttctgcacaagaagccagtacgttgcaagaaaaacgaaatgtcatatgtcaaccctcctgcaggacaaacttgcggagaatatatgtccgcgtttttgaagacggctgctggttatatcaacaacccgaatgatactgaaaactgtggatactgtgttttcgaggttggtgacgattacctgagccagattagcgtcaagtacagctacttatggagaaattttggatttttctgggtgtacatttgcttcaatatcttcgcgatggcagttttgtattacattttccatgtcagaagcttttcattgaaacagacaaaattagggaagatgatcatgggcaagatgaagaaggagtga

SEQ ID NO: 156 - protein, 1499 aa, Kluyveromyces thermotolerans
MSADVQAKSGAEPRSGAASSRSEAEHEAAYTGPGTKEEFQDARQSDGQAARDHIVRLMARRTSSVGEEEDLDPEVLSRVETLARTLSSHRMRNGVLQVDPDDFDAEAIIRAHVRGSEEQGIHLRRAGVIGENFTVVGKDCSSVEAQTFEDILLLPRTIFRGIREAKNRKTRDIVRNANILARPGEMILVLGRPGAGCSSFLKTVSGEVDNFEEVRGEISYDGISQKEMMAKFKTDVIYNGETDVHFPHLTVQQTLDFALSCTTPQKRLDNASRSEYITAMRELYGTIFGLRHTYNTKVGNDFVRGVSGGERKRVSIAEALASRGSIYCWDNATRGLDASTALEFAQAIRIMTNLQKSVAFVTIYQASENIYECFDKVTVLFDGRQIYYGHVEDAKAYFKKLGFLCPARQASAEFLTALTDPNGLHEYVPGFENKVPRTADEFEKLWLESQEYQDLLKDIDNYKRETEAEKTKELFSASLAQEKSKLNRKKSKYTVSFAEQVKLCTKRGVQRIYGDKAYTITNLIASIIQSLVSGSLYYNLPSGVSGAFSRGGVFYFSILYVSLMGLAKISLDGRPVVQKHKSYSLYHPAAEALATSLSEFPFRFLSQTCFYIIIYFLSGLTREANRFFTSFLFLILCSESINAFFELITAFSSSVAQANSIAGTSLMALVLYSTYMIQLESMHPWFKWISYCIPIRYTFESMLNSEFHARKMDCTGSIIPAGPAYANVATENQVCAFVGSKPGQDYVNGDDYIKANYGYKYDHTWRNLGFLFAFLAVYVALKCLITELNTTSMGSGDTLVFKKGAKRVSPSSDEESREKSLTMSEAKKNLDSNASTSGSSAEALQGLKSTGIFIWRNVCYTIPYRGSTRRLLDNVSGYCAPGTLTALMGESGAGKTTLLNTLAQRNVGIITGDMLVNGNHIDASFERRTGYVQQQDVHVKEMTVRESLQFAARMRRPQSVPEAEKMAYVEDIIEILDMEEYADALVGDVGYGLNVEQRKKVSIGVELAAKPDLLLFLDEPTSGLDSQSSWAIVQLMRRLAEAGQSILCTIHQPSATLFEQFDRLLLLKKGGQTVYFGPIGKNSRTLLNYFEGNGARKCEHTENPAEYILEAIGAGATASVKEDWHEIWTNSPQFNEANEEIENYLRDSKQNSPPADKNEKISKYATSYSYQFRYVLQRTATIFWRNSEYLIAKMMLYISAGLFIGFTFYNVGTSYRGLQNTMFAAFMALIVSAPAMNQIQARAIASRELFEVRESKSNTFHWIFLLLTQYLCEIPYHLVFSTLFFVAFYFPLRVHFAATYSGVFFLNYCIMFQLYLVGLGLMLLYAAPNLPSAGVLLSLCLSFLISFCGVVQPASLMPGFWTFMWKASPYTYFVQNAISLVLHKKPVRCKKNEMSYVNPPAGQTCGEYMSAFLKTAAGYINNPNDTENCGYCVFEVGDDYLSQISVKYSYLWRNFGFFWVYICFNIFAMAVLYYIFHVRSFSLKQTKLGKMIMGKMKKE

SEQ ID NO: 157 - DNA, 4563 bp, Saccharomyces castelli
atgtctgaaaaaaagactttagacgtatcttcaatcaactcaattgatccatcaaatgacaattctgctaattccactaattctgagaacttacatgaatatcatgggttcgatcaaactgctgaagaagaaattagagaattagcaagaactttaactattcaaagtgttaacaatgcctcagttcacgaatcaatcaatgaactggaaaatcaatcaatttttactccagaaatggaaggtatcaacccagtgtttactaatccagctaatccaggttacaaccccaaattagatcccgtctctgaagatttctcttccaaggcttgggtccaaaatatggcaaacatctctctagcagatccagatttttacaagccatattctcttggttgtgtttggaaaaacttgagtgcatccggtgaatcatctgatgtcgcataccaatcaactttcttgaacatgccatacaaaatattaagtacaggttacagaaaattaaagtcttccaagaccgaggacagattcgaaatcttgaagccaatggatggttgtttaaatccaggtgaattattagtcgtcttgggtagaccagggtccggttgtaccactttattgaaatccatctcttcaaacacacatggtttcaagatcagtgatgaatcgactatctcatacagtgggttgacaccaaaggaagtaaagagacattaccgtggtgaagtcgtttataacgcagaagctgatatccatttaccacatttaactgttttccaaactctatacacagtcgccagattaaagactccaactaaccgtattaaaggtgttgacagagacacttttgcaagacatatgactgaagtcgctatggctacatatgggttatcacacacaagaaatactaaagtcggtaacgatttagttagaggtgtttccggtggtgaaagaaagcgtgtttccatcgctgaagtttccatttgtgggtccaagttccaatgttgggataatgccactagaggtttagattctgcaaccgctttagaatttattcgtgctttgaaaactcaagctaccatctccaactccgctgccactgtggctatctaccaatgttctcaagatgcttatgatctatttgataaggtttgtgtcttggacggtggttatcaattatactatggtcctggtaacaaggctaaaaaatatttccaagatatggggtatctatgtccagaaagacaaaccactgctgatttcttaacatccgtgaccagtccagctgaaagagtcatcaacccagaatttatcaagaagggtattaaggttccacaaactccaaaggatatgggtgattattggttaaattctcaaaattacaaggaattaatgactgaaattgatcgtaaactaagtgaaaacgtcgaagaaagtcgtgaaaccatcagaggagctcatgttgctaaacaatcaaagagagcaagaccatcatctccttacactgtcagttatgggttacaagttaaatatcttctagaaagaaatttctggagaatacgaaataatgcatccattagtttgtttatgatcttcggtaatagttccatggctttcattttaggttccatgttttacaaagttatgaggaaaggtgatacctcaacattttatttccgtggtgcagctatgttcttcgccattttgtttaacgcattctcatgtctattagaaattttctccctatatgaagcaagaccaattactgaaaagcatagaacatattctctttatcatccaagtgcagatgcattcgcatccattatctccgaaattccaaccaaattttgtatcgctgtttgtttcaacattatcttctatttccttgtgaacttcagaatgaatggtggtgttttcttcttttatctattaatgaatgtcgtcggtgtcttctgtatgtcccatatgtttagatgtgtcggttctttaactaaatcactatcagaagctatggtgcctgcatcaatgttgttactagccctatccatgtatactggttttgcaatcccaaaaaagaagatgttacgttggtcaagatggatctggtacattaatccattatcttacttatttgagtctctaatgattaatgaattccatgatgttaaatacccatgtgcacaatatattccatttggtcctgcttatgctaacatctctggtactgaaagagtttgttccgctgtgggtgctgtcccaggtcaagcttacattttaggtgacgattatattaaggaaagttatggttacaagcatagtgagaaatggcgttcccttggtattggtttggcttatgctatcttcttcttaggtgtttacttgttcctttgtgaatataatgaaggtgcgaagcaagctggtgaaattttagtcttcccacgtagtgttattaaacgtttaaagaaagaaggtaaattgagagaaaagaatactgccgaagatatcgaaatggctgctgatactagtgtcactgataaacaattactctcttccgatgaaatggctgaagaaagtggtgccaatattgggttaagtaaatctgaagccatcttccattggagaaacttatgttatgatgttcaaattaaggatgaaacaagacgtatcttaaacaatgtcgatggttgggttaagcctggtactttgactgccttaatgggtgcctctggtgctggtaagactactttattagattgtttagctgaaagagttactatgggtgttattacaggtgatgttttggttaatggtcgccctcgtgatcaatctttcccaagatctattggttactgtcaacaacaagatttacatttgaagacttccactgttagagagtctttgagattttctgcttacttgcgtcaaccagctgatgtttccattgaggaaaagaaccaatacgtggaagatgttattaagattttagaaatggaagcgtatgctgatgctgttgtcggtgttgccggtgaaggtttgaatgttgaacaaagaaagagattaactattggtgttgaattgactgccaaaccaaaattattggttttccttgatgaaccaacctctggtttagattcccaaactgcttggtctatttgtcaattgatgaaaaaattggctgatcatggtcaagctattttgtgtactatccatcaaccctctgctattttgatgcaagaatttgaccgtctattgtttatgcaacgtggtggtagaactgtttatttcggtgatttaggtaaaggttgtcaaactatgattgattattttgaaagaaatggttctcacccttgtcctgctgatgccaatcctgctgaatggatgttggaagttgtcggtgctgccccaggttctcatgccaaccaagattaccatgaagtttggagaaactctgctgaatacaaggctgtccaagaagaattagattggatggctcaagaacttccaaagaaacaagttgaagaatctgctgctgatcaaagagaatttgccacttctgttccatatcaagccaagattgtcagtattcgtctttttgaacaatactggagatctccagaatatttatggtccaagtttatcttgactattttcaatcaattgtttatcggtttcactttcttcaaggctgacacatctttacaaggtctacaaaaccaaatgttgtccatcttcatgtttgtctgtattttcaatccaattttgcaacaatatttaccatctttcgttcaacaaagagatttgtatgaagctagagaacgtccatcaagaacattttcctggaaggcatttatcttctcccaaattgttgttgaagttccatggaatttattagctggtactttagctttcttcatttactactatccaattggtttctacgctaatgcttctgctgctggtcaattacatgaaagaggtgctcttttctggttattctcctgtgctttctacgtttatgttggttccatgggtttagctgctatttctttcaatcaattagccgaaaatgctgccaatttagcctctttgttgtttactatgtctttatctttctgtggtgttatgactactccaggtgctatgccaagattctggattttcatgtacagagtatctccattaacttatttcattgatgctactttagctgttggtgttgccaacgttgatgttcactgttctgattatgaattactaagatttactccagcttcaggtatgacttgtggtgaatatatgacaccatacatggaaatgatgggtactggttatttgaaagactcttccgctactgatcaatgtgaattctgtaccgtctctcacactaatgaatatttgtcccaagttaattcgtcctattctaggaggtggagaaactatggtattttcatctgttacattgccattaattacatctttgctgttctcttctattacatggctagagttccaaagaataagggtaagagtagcagtaagggctttttatccaagttcaagaaataa

SEQ ID NO: 158 - protein, 1520 aa, Saccharomyces castelli
MSEKKTLDVSSINSIDPSNDNSANSTNSENLHEYHGFDQTAEEEIRELARTLTIQSVNNASVHESINELENQSIFTPEMEGINPVFTNPANPGYNPKLDPVSEDFSSKAWVQNMANISLADPDFYKPYSLGCVWKNLSASGESSDVAYQSTFLNMPYKILSTGYRKLKSSKTEDRFEILKPMDGCLNPGELLVVLGRPGSGCTTLLKSISSNTHGFKISDESTISYSGLTPKEVKRHYRGEVVYNAEADIHLPHLTVFQTLYTVARLKTPTNRIKGVDRDTFARHMTEVAMATYGLSHTRNTKVGNDLVRGVSGGERKRVSIAEVSICGSKFQCWDNATRGLDSATALEFIRALKTQATISNSAATVAIYQCSQDAYDLFDKVCVLDGGYQLYYGPGNKAKKYFQDMGYLCPERQTTADFLTSVTSPAERVINPEFIKKGIKVPQTPKDMGDYWLNSQNYKELMTEIDRKLSENVEESRETIRGAHVAKQSKRARPSSPYTVSYGLQVKYLLERNFWRIRNNASISLFMIFGNSSMAFILGSMFYKVMRKGDTSTFYFRGAAMFFAILFNAFSCLLEIFSLYEARPITEKHRTYSLYHPSADAFASIISEIPTKFCIAVCFNIIFYFLVNFRMNGGVFFFYLLMNVVGVFCMSHMFRCVGSLTKSLSEAMVPASMLLLALSMYTGFAIPKKKMLRWSRWIWYINPLSYLFESLMINEFHDVKYPCAQYIPFGPAYANISGTERVCSAVGAVPGQAYILGDDYIKESYGYKHSEKWRSLGIGLAYAIFFLGVYLFLCEYNEGAKQAGEILVFPRSVIKRLKKEGKLREKNTAEDIEMAADTSVTDKQLLSSDEMAEESGANIGLSKSEAIFHWRNLCYDVQIKDETRRILNNVDGWVKPGTLTALMGASGAGKTTLLDCLAERVTMGVITGDVLVNGRPRDQSFPRSIGYCQQQDLHLKTSTVRESLRFSAYLRQPADVSIEEKNQYVEDVIKILEMEAYADAVVGVAGEGLNVEQRKRLTIGVELTAKPKLLVFLDEPTSGLDSQTAWSICQLMKKLADHGQAILCTIHQPSAILMQEFDRLLFMQRGGRTVYFGDLGKGCQTMIDYFERNGSHPCPADANPAEWMLEVVGAAPGSHANQDYHEVWRNSAEYKAVQEELDWMAQELPKKQVEESAADQREFATSVPYQAKIVSIRLFEQYWRSPEYLWSKFILTIFNQLFIGFTFFKADTSLQGLQNQMLSIFMFVCIFNPILQQYLPSFVQQRDLYEARERPSRTFSWKAFIFSQIVVEVPWNLLAGTLAFFIYYYPIGFYANASAAGQLHERGALFWLFSCAFYVYVGSMGLAAISFNQLAENAANLASLLFTMSLSFCGVMTTPGAMPRFWIFMYRVSPLTYFIDATLAVGVANVDVHCSDYELLRFTPASGMTCGEYMTPYMEMMGTGYLKDSSATDQCEFCTVSHTNEYLSQVNSSYSRRWRNYGIFICYIAINYIFAVLFYYMARVPKNKGKSSSKGFLSKFKK

SEQ ID NO: 159 - DNA, 3930 bp, Ashbya gossypii
atgaagaacaggtctttacgagctaacggcgcgtctattggaggcaaaaacaacataagtgatatagaagagtacaatagtaatgctaccataatacgtgacctcacatttaaagttggagccggtgagattgtgttggtagttggtgataaatcgtcccaatttttacggaatttggctgacggtaatagtgcaataagccctgaaaacaagttagtatttaaaaattatgaatatttgaaatttgcagaaagatgcaccggagagataatatatagcaatgcggaggataaccatatgaaacagttaacagtccaagagactattgattttgctgtaaattgcaatgtcgacgtcgcaaaagaggataaaatacttctccgggacacactactcagcgcattcaaattgagcgaagtcaggcacactttagtggcggatgagaactcctcaaaactttctgtgggtgaacgaagaagactatccatcattgaagcctttctaggaaatgcgtccttatatttatgggataattgcacgaatggattggactctatgactgcgatggacattatacaaggattaaaattgatggctcgggttacaaaaacagtgaacttattcgggtgtacccaggccaacggcatcttgttgggccaggtcgacaaagttttggtcttgataggggactaccaggtattttatggctcttaccaagattgcatattgttttttgaaagtctttatttcccgaaagacccaaacctactggatagtgaatacttcagtgcggttatttatggttccatccagagcccgttaattaagacagattctgactttcataggcagtggattcattcttcatactacaggaaagtaaatgatgaatcacagataaaatactcaaaaaaaactatagatctgaaagacctgaagagtcttcaaccggtatctgcactgcgccaagtcatatattgtgttctccgttcgtggaatatgtttcgttcagataaatttgctacgggcctccaggtgacgacagcgtttctgagatctttaacactcggtgcactatttctcgatttaccgactactgctgtgggttcacaggcaagagaacgcttaatcttttacatccttctcatgtgtatgttctctggaataacaactgttccactgatattcgaccggagaccagtgatcatgaagcaaatccaaatgcaattttacaggccatggacagactccttagccaatactacgttatccctttccgtaaaccttattttggtaaccatatcctcaagcgtcctctatacaatggtggactttcaacgtagtttgttgaggttttcggtctttattttaattgcgataaccagcgactgtatcatacatttgatgttcttaacaattgccaatatctccccaaattcagcgcttgcaaacggattaagtggaatattgttgatttcagcatcagttaccggttcgttgggaattccattgaagcagatgaacagatggtttaaagttctttcactaataaacccgatcaggtacgcaggcgaaacatttttaaccaatgaattattcaatgtttccctagaatgcgcagatatgctggttccaggaggtgctgcgtatcaaaatgtggcaggttcgttcagaacgtgtgtatggcccggagctgaaccagaatcctcggtgataaatggtacaaaatacctaagtgctcaattcgcattctcacatgcacacttctggaaaaattacggtatcttacaggccttttccatatttttctttattgcttcgttattgagcgccgaatacatcatgccactattctgtaccaagtacgccccacgaatatgttggccaagagaaaaatatgaaaattgtcatcctgcccgaatcaagttgcgcaaggaagtagtcatcgataatgactcgcattctactttctgtagcgatcgattcatcgaaaaggcgtatgccgtagcgccctcctcctcatgtggtacaagagaattctcttacggaaatgagctatatcatagcatcatatcatggagtaacctatcttatcaggtaaatggtaagatgttacttcaaaatattagcggctatattggacctggcttgtgcttagtcctcggcgaatccagttctggaaaatctgcattgttgaacgttttggcacgcagggaagctagtggcatcactgggaatttaatgctcgccggaaggcctattaaagactatccaaattaccttatcgaagtgggatatgttccccatttgtatgctcatttcggctcattgaaagttatcgtaccgttagaattttcggccaatataagaggccaaacagataaggtacatatttcagaggtcctttcaatgttgaatttatcaggtcagaggtatgtcgatgctctatgtttgcaggagaaaaggatactctctatagggcccgagttggcttcaaaaccagctgttgcgttattcgttgatgagccctctatgggcatggattctgaggcagccattgccatgattgaacgtttaaacaggttggctgatgaaggacagacaatattatgttctataagtcagccaagtaaatctatctttcattattttgataacttgatagtgttggataagaatggccagtgcgtttactttgggtctactgagggtgcgatttcatacttcacaaaacattcagcaatccaatacgatgagagaaaacacaacccttctgacctcatcctcagcataatcaggtcaaacttaaaggatagaacttgggcggaaaattggcaatgcacaaaggagtacgctgcggcagaagcaactcgaattgaattagaaagaaagtctttcggggcatgggcgtcagatcaacgccatctggactctttcctaacgtggcccacttgcttttgcgcaacattaaagaggcagttcatacttatagctagggacaaaagctatttgacatctcgaattatactcagtctgactacaggcttataccttgccggtagcctttggaatactgggaatagcggaagtgcattggataccactattttttctgtattcgtattccttgctatgtcgctgccactggcacaacagattcagacaaaggcagcgaccgtgatgaaggcctacatcaccagagaaatgaagtcacacacagttggatggtcaacattgatggcagcccaatttcttgcggaaattccgctccttctctcatgctgtgtgctgttttatttttgcatctattgcactatgggaactagcgtcaatccagccgtgatggacgcgtttttcgtgaattgtctagtatttgggctatattgcctttcaatagggcttgcaacactgttcgttggactaaaagtttatcattcaactgcattactcagccttgtttccagtttgctactagcagtgtgtggtatattgcaacccaatttgaaagtcaccccgatctggcgcaccatataccagatgtctccattgacatattttgcggatacattcaccagtttgctactctatgataagcacatcctctgctcgcaggacgatttaatatctgtatctcgccccgatggtcagtcttgcagtgagtacttcggcacatttattcaggagttcggaggaaagatagttgaccatgctgataaaaacatgtgcgcatactgctcttctgacgagatcagcaactttttgagtttgcgtgatatgtcatacaaccatatttggcgcaatgttgcgatctgttccgcatttgtggcgcttaactttgccgcgatgatatgcagattccatctcttcaatgcaccattaagcctagcgaatataccaggtagacttcaagcggtttttaagcataaatag

SEQ ID NO: 160 - protein, 1309 aa, Ashbya gossypii
MKNRSLRANGASIGGKNNISDIEEYNSNATIIRDLTFKVGAGEIVLVVGDKSSQFLRNLADGNSAISPENKLVFKNYEYLKFAERCTGEIIYSNAEDNHMKQLTVQETIDFAVNCNVDVAKEDKILLRDTLLSAFKLSEVRHTLVADENSSKLSVGERRRLSIIEAFLGNASLYLWDNCTNGLDSMTAMDIIQGLKLMARVTKTVNLFGCTQANGILLGQVDKVLVLIGDYQVFYGSYQDCILFFESLYFPKDPNLLDSEYFSAVIYGSIQSPLIKTDSDFHRQWIHSSYYRKVNDESQIKYSKKTIDLKDLKSLQPVSALRQVIYCVLRSWNMFRSDKFATGLQVTTAFLRSLTLGALFLDLPTTAVGSQARERLIFYILLMCMFSGITTVPLIFDRRPVIMKQIQMQFYRPWTDSLANTTLSLSVNLILVTISSSVLYTMVDFQRSLLRFSVFILIAITSDCIIHLMFLTIANISPNSALANGLSGILLISASVTGSLGIPLKQMNRWFKVLSLINPIRYAGETFLTNELFNVSLECADMLVPGGAAYQNVAGSFRTCVWPGAEPESSVINGTKYLSAQFAFSHAHFWKNYGILQAFSIFFFIASLLSAEYIMPLFCTKYAPRICWPREKYENCHPARIKLRKEVVIDNDSHSTFCSDRFIEKAYAVAPSSSCGTREFSYGNELYHSIISWSNLSYQVNGKMLLQNISGYIGPGLCLVLGESSSGKSALLNVLARREASGITGNLMLAGRPIKDYPNYLIEVGYVPHLYAHFGSLKVIVPLEFSANIRGQTDKVHISEVLSMLNLSGQRYVDALCLQEKRILSIGPELASKPAVALFVDEPSMGMDSEAAIAMIERLNRLADEGQTILCSISQPSKSIFHYFDNLIVLDKNGQCVYFGSTEGAISYFTKHSAIQYDERKHNPSDLILSIIRSNLKDRTWAENWQCTKEYAAAEATRIELERKSFGAWASDQRHLDSFLTWPTCFCATLKRQFILIARDKSYLTSRIILSLTTGLYLAGSLWNTGNSGSALDTTIFSVFVFLAMSLPLAQQIQTKAATVMKAYITREMKSHTVGWSTLMAAQFLAEIPLLLSCCVLFYFCIYCTMGTSVNPAVMDAFFVNCLVFGLYCLSIGLATLFVGLKVYHSTALLSLVSSLLLAVCGILQPNLKVTPIWRTIYQMSPLTYFADTFTSLLLYDKHILCSQDDLISVSRPDGQSCSEYFGTFIQEFGGKIVDHADKNMCAYCSSDEISNFLSLRDMSYNHIWRNVAICSAFVALNFAAMICRFHLFNAPLSLANIPGRLQAVFKHK

SEQ ID NO: 161 - DNA, 4578 bp, Kluyveromyces lactis
atggatgctgattcaacctccagtctggtcgagtaccaggggtttgatcatcaggttcaggagcaaatcagagatttggctcgaactctctcacgcaacagtctgaaagaacaagcatctcaacaagaatcgactggaaacgtacttgcttctgatgatgatggtgcgaaatcgattttcagtactaggtacgagggtgtgaatcctgttttcactgattcagatgcttcaggatatgatgtcagattggacccaaattcagatgaattttcgtctgctgcgtggatcaagaatatggtcgccttggctaataatgatccagaatattacaagcattacacgatagggtgttgttggaaggacttgagagctttcggtgactctacagacgttgcttaccaaagcacagtgttgaacttgccaggtaagatattttccagcgtaaagagacatttcgtgaaaagtaaaccagaagacgttttcgatatattgaaacctatggatgggttgttaaaaccaggtgatttgttagttgttctaggtcgtccaggttctggttgtacaaccttgttgaaaactatctcgtctaacattgatggttataacgtcgatgagaattccgttatctcttataatgggttggatccaagaactatcaaaaagcattttcgtggtgaagtggtttacaacgcagaaagtgatgtgcatttccctcatttgtcagtatatgaaactttgtacaatattgcgctcttagttactccttctaaccgtatcaaaggtgccactagggaagaatttgccaatcacgtgacacaggttgcaatggctacttacggtctatcacacacaagggatacaaaagttggtaacgaattggtcagaggtgtatcaggtggtgaacgcaagcgtgtttcgatcgctgaagttaccatttgtggttccaggttccaatgttgggacaatgctactcgtggtttggattctgccactgctttagagtttattcgtgcattgaaaacaagtacagatatctcaggttcgactggtgttatcgcaatttaccaatgttcacaggatgcttatgatttatttgacaaagtctgcgtgttacatgaaggttaccaaattttttacggtaacgcaaaggctgctaaggcatacttcgaaagaatgggatatgtctctccttcaaggcaaacaaccgctgacttcttgaccgctgtgacaaatccagccgaaagaattgttaaccaagaattcgtcaaagaaggcagatttatcccatctacagctaaacaaatggaagaatattggagaaactcgccagaatataagcaactacgtggagagattgaagaagaattgaataaggattcaactcaaactcgtcaagagcttattgaagctcatattgcaagacaatctaaacgtcaaagaaaggaatctccatacattgtgaattacggtatgcaagtgaaatatttgacaatgagaaactttttgcgaattaaaaaaagttatggtattactgtgggtactatcgttggtaacactgcgatgtccttagtgttaggttcgatcttttataagtcaatgaaagatacaacaacaaacactttcttctaccgtggtgctgcgatgtttattgcggttcttttcaattctttctcttctatgttggaaatcttctcattgtatgaagctagaccaattattgaaaaacacaaaagatattctctataccatccttctgctgatgccttagcttcgatgctttctgaattgccagccaaaattataaccgctatctgtttcaatttgattttatacttcatggtgaacttcagaagggaagctggtccatttttcttctactttttgatgaatttccttgctaccctagtcatgtccgctatcttcaggtgtgtcggttctgctacaaaaacgttgtcagaagcgatggtaccagcatcatgtctattgttagccatctcattatatgttggattctccatcccaaagaagaatttattgggctggtctcgatggatttggtacatcaatcctctatcctatatctttgaatccctaatgatcaacgaatttaatggtagagatttcccatgtgcagcttatatcccatctggcagtggttatgaaaatattgggttatatgagagagtctgtaataccgtcgcttcgcaacctggtctttcttatgttagtggtagagctttcattgaagaagcctatggttacaaccctagtcacagatggcgtgcattgggtattgctcttgcttatttcatcttcttcacggcgttctatttactattctgtgaatttaacgaaagtgctgttcaaaaaggtgaaatattactattcccaaaatctgttttgaaaagggctaagaagcaaaagttaattaaggcaaagcatgatgtagaggctgttcaagattctgaaggtgctctcaccgaccaaaaactgttacaagactccttagttgaatcaaatatttcttcaagttctgataaaagcgtcaatgttggtctctctaaatctgaagcaatcttccattggaggaacgtttgttatgacgtccaaataaaaaaggaaacacgtcgtatcctatctaatgttgatggttgggtcaagccgggtactctaactgccttgatgggttcatcgggtgctggtaaaaccactttattggattgtttggcttcaagagtgacaatgggtgttattacaggtgacatgttcgtcaatgggcacttgcgtgataattctttcccaaggtccatcggttactgtcaacaacaagatttgcacttgtcaacttctactgttagagaatctttgagattttcagcatacttgcgtcaaccttcgagcgtatcaattgaggaaaagaacaattatgtcgaagacgtgattaatatcttggaaatgcaacagtatgcagatgccgttgttggtgttgctggtgaaggtttaaatgttgagcaaagaaagagattgactatcggtgtagaattggcagccaaaccaaaattgttgttattcttggatgaaccaacttctggtttggattctcaaactgcttggtccgtttgtcaattaatgaggaaattagctgatcacggtcaagccattttgtgtacaatccatcaaccttccgcattgttgatgcaagagtttgatatacttttattcctacaaaagggtggtaagactgtttactttggtaatttaggtgaaggttgtcaagaaatgattaactactttgaaaaacatggtgcgtcaaaatgtcctgagggtgctaacccagctgaatggatgttggacgttattggtgctgcgccaggttctcatgcaactcaggattaccatgaagtgtggagaaattctgatgaatatcaagctgttcaaaaggaactagattggatggaatctgagctacgtaagaaaccgttagatacttcttctgaacaaagcgaatttggtacttctctattctatcagtacaaggttgttacattacgtcttttcgaacaatattatagaactccatcgtacatttggtcgaagcttttcttgaccatcttctcgcagttgtttattggtttcacatttttcaaggctaacttatccattcaaggtttgcagaatcaattattcgctatcttcacattcacagttatctttaatccagcttgtcaacaatacttgcctttgttcgtctctcaaagagacttgtacgaagctagggaacgtccaagtagaacattttcttggctggcatttatcttctctcaaatcaccgttgaaattccacttaacatatgttttggtaccattgccttcttcgttttctactatcctattggtttctacaacaatgcgtcatatgccggtcaattaaacgaaagaggtgtgttattctggttattctctgtttccttctacgtatttatcagttcaatgggtcaattgtgtattgcaggtcttcagtatgctgaggctgcaggtaatatggcatcattaatgttcactatgtccttgaatttctgtggtgtgtttggtggttctggtgttttgccagggttctggattttcatgtaccgtatttcaccgctaacttactttattgatggtgtactctcaactggtcttgcaaacaaccctgtaacatgcgcaaactatgaatacgtcagctttaatccaaggagtggagaaacctgtggtgagtacatggcggactatattgacaagaatggtggttatctactagattcaaatgctacggaagattgtaatttctgtaagatttctgaaacaaacgcatttttgacaagtttccaatcttcgtaccatagaagatggagaaatttcggtattttcatagtcttcattgtgttcaactggtgcggttgtgttttcctatactggttggctagagttccaaagaagaagaacagagtggctgatgagagagacccagatcatggcaagaaaattgaaaatgttcaaaaggaaaaggttgaacctcaatccaatgaacaagtttaa

SEQ ID NO: 162 - protein, 1525 aa, Kluyveromyces lactis
MDADSTSSLVEYQGFDHQVQEQIRDLARTLSRNSLKEQASQQESTGNVLASDDDGAKSIFSTRYEGVNPVFTDSDASGYDVRLDPNSDEFSSAAWIKNMVALANNDPEYYKHYTIGCCWKDLRAFGDSTDVAYQSTVLNLPGKIFSSVKRHFVKSKPEDVFDILKPMDGLLKPGDLLVVLGRPGSGCTTLLKTISSNIDGYNVDENSVISYNGLDPRTIKKHFRGEVVYNAESDVHFPHLSVYETLYNIALLVTPSNRIKGATREEFANHVTQVAMATYGLSHTRDTKVGNELVRGVSGGERKRVSIAEVTICGSRFQCWDNATRGLDSATALEFIRALKTSTDISGSTGVIAIYQCSQDAYDLFDKVCVLHEGYQIFYGNAKAAKAYFERMGYVSPSRQTTADFLTAVTNPAERIVNQEFVKEGRFIPSTAKQMEEYWRNSPEYKQLRGEIEEELNKDSTQTRQELIEAHIARQSKRQRKESPYIVNYGMQVKYLTMRNFLRIKKSYGITVGTIVGNTAMSLVLGSIFYKSMKDTTTNTFFYRGAAMFIAVLFNSFSSMLEIFSLYEARPIIEKHKRYSLYHPSADALASMLSELPAKIITAICFNLILYFMVNFRREAGPFFFYFLMNFLATLVMSAIFRCVGSATKTLSEAMVPASCLLLAISLYVGFSIPKKNLLGWSRWIWYINPLSYIFESLMINEFNGRDFPCAAYIPSGSGYENIGLYERVCNTVASQPGLSYVSGRAFIEEAYGYNPSHRWRALGIALAYFIFFTAFYLLFCEFNESAVQKGEILLFPKSVLKRAKKQKLIKAKHDVEAVQDSEGALTDQKLLQDSLVESNISSSSDKSVNVGLSKSEAIFHWRNVCYDVQIKKETRRILSNVDGWVKPGTLTALMGSSGAGKTTLLDCLASRVTMGVITGDMFVNGHLRDNSFPRSIGYCQQQDLHLSTSTVRESLRFSAYLRQPSSVSIEEKNNYVEDVINILEMQQYADAVVGVAGEGLNVEQRKRLTIGVELAAKPKLLLFLDEPTSGLDSQTAWSVCQLMRKLADHGQAILCTIHQPSALLMQEFDILLFLQKGGKTVYFGNLGEGCQEMINYFEKHGASKCPEGANPAEWMLDVIGAAPGSHATQDYHEVWRNSDEYQAVQKELDWMESELRKKPLDTSSEQSEFGTSLFYQYKVVTLRLFEQYYRTPSYIWSKLFLTIFSQLFIGFTFFKANLSIQGLQNQLFAIFTFTVIFNPACQQYLPLFVSQRDLYEARERPSRTFSWLAFIFSQITVEIPLNICFGTIAFFVFYYPIGFYNNASYAGQLNERGVLFWLFSVSFYVFISSMGQLCIAGLQYAEAAGNMASLMFTMSLNFCGVFGGSGVLPGFWIFMYRISPLTYFIDGVLSTGLANNPVTCANYEYVSFNPRSGETCGEYMADYIDKNGGYLLDSNATEDCNFCKISETNAFLTSFQSSYHRRWRNFGIFIVFIVFNWCGCVFLYWLARVPKKKNRVADERDPDHGKKIENVQKEKVEPQSNEQV

SEQ ID NO: 163 - DNA, 4695 bp, Saccharomyces cerevisiae
atgttgcaagcgccctcaagttcaaactcgggtttgaatcaaggaaatgctgcgccggacggcccacctaacgaaacacagccgtacgaaggcctcgacgcggcagctcaagaagaaataaaagaattggcaagaacgctgacgagccaatcttcccttttatcgcaagaaaagcgtattaccggcactggcgacccgaatacactaactgctgcttcttcatcgtcattgagccggtcaattttcgctagtgatatcaagggagttaacccaatccttttggacgtcaatgatccagactacgatgagacattggatcctcgatcagaaaatttctcgagtgtcagatgggtacgaaatatggcacaaatatgcgagaatgattcggatttctataaaccgttttcattaggttgcgcctggaaagatttgagtgcctccggtgattctgccgatataacatatcagggaacatttggtaatatgcccatcaaatacttgaaaatgagttggaggtgcatatcccgacgtcttttccaccggacacatggcaagagtgaagataatgactccggtttccaaattttgaagccgatggacggatgcatcaatccgggggaactacttgttgtgcttggacgacccggtgcaggatgtactacgctgctgaaatctatatctgtaaatacacacggattcaagatttctccggacacaatcatcacgtacaatggattctccaacaaagagatcaaaaaccattaccgtggtgaagtggtctacaatgcagaatcagacattcacatcccgcacttgacagtattccaaactttatacacagtggcaagactgaagacaccaaggaaccgaatcaagggtgtcgatagggacacatttgccaaacacatgactgaagtggcaatggcaacttacggactgagccacactgcagatacaaaagtgggtaatgattttgttcgtggtgtatccgggggagaaaggaaaagagtttccattgctgaagtgtctatatgtggctcgaagtttcagtgctgggataatgccacgaggggcttagattctgctaccgcgctggagttcatcaaggccttgaaaacgcaagccactatcacaaagtctgcagccactgtggccatttaccaatgttctaaagatgcctatgatttgttcgataaagtctgtgttctttacgatggttaccaaatcttctttggcccaagtaagcaggccaaaaagtactttcaaagaatgggatatgtgtgtcccgaaaggcagaccacagcagattatttgacctctattactagtccttctgaaagaattaaggacaaagacatggtcaaacatggaattatgatcccacaaacggcctatgaaatgaaccagtactggattcaatcagaggaatacaaacaattacaggtgcaggtgaacaaacatttagatacagactcttcccagcaaagagaacaaataaaaaatgcacatattgccaaacaatctaagagagcacggccctcctctccttatacagtaagtttctttttgcaagttaagtatattctaatcagggatatatggaggattaagaatgacccaagtattcaacttttcacggttttgagtcatgcagcaatggctcttatcttgggatcaatgttttatgaagtcatgctttccactaccacaacaaccttttattaccgaggcgcggctattttttttgctattctgttcaatgcgttctcatcacttttagagatcttttcactctatgagacgaggcccattaccgaaaagcacaagacttactcgttatatcgcccaagtgctgatgccttcgcctctacattttctgatgttccaacaaaattagccacggcagtaactttcaacataccatattattttttaatcaatctaaaaagagatgccggtgcttttttcttttactttttaataaacattataacagtttttgctatgtcgcatttgttcagatgcattggctcagtgtcgaaaactttacctcaggcaatggttcccgcatctgttcttctgttagcttttgcaatgtacactgggtttgccatcccaagagtccaaatgcttggctggtcaaaatggatttcttatatcaacccattgtcttacctttttgaatcgctaatgattaacgaatttcatggtagaaatttcccatgtgctcagtatatacctagtgggccaaattatgtcaacgcaacaggtgacgaagtcacctgctccgccctcggttctatcccaggaaataattatgtaagtggtgatgatttcattcaaacgaactacggctatcgacataagaacaaatggcggtctgttggtattggtttagcatacattatttttttcttatttctgtatttattcttttgtgaatacaatgaaggagcaaagcaaaatggtgagatgttagtatttccccatagtgtggttaaaaagatgaagaagaagggtattgtctctgagaagaaaaagaaaaaccaaccaacgttgtcaacatctgatgctgagaaagatgtagagatgaacaacaattcaagtgcgactgattcaagatttttacgcgattctgatgcagctataatgggtaacgataaaactgtcgccaaggagcattattcatctccttcatcttctgcgtctcaaagcaatagttttagtaaaagtgatgacattgaattgtccaaatcacaagcgatttttcattggaaaaacttatgctacgatatcccgattaagaatgggaagaggagaattttggataatgttgatggttgggtcaagcctggtacactaactgccttgattggcgcatctggtgcaggaaaaacaacgttattagattgtcttgccgagagaaccacgatgggtttaatcactggtgatgtattcgtagatggtagaccgcgggaccagtctttccccagatcaattggttattgtcagcagcaggatttgcatttgaaaaccgcaactgtgagagagtcattaaggttttccgcgtacctgcgtcaagccgatgatgtatccatcgaggagaaagataaatacgttgaagaagtcattgaggtattggagatgaaactttatgctgatgccatagtaggcgttcctggtgaaggtttaaatgtggaacaaagaaaaaggttaaccataggtgtggagttagctgccaaaccaaaactgttggtatttttagatgagcccacgtctgggcttgattcccaaactgcatggtcaacttgtcaattaatgaagaaattggctagtcgcggacaagcaattttatgtaccattcatcaaccttctgctctcttaatgcaagagtttgataggttactatttttgcaagagggcggacaaactgtatattttggagagctagggaaaggttgcaaaacaatgattaactatttcgaagctcatggtgcccataaatgcccaccagatgccaatccagccgaatggatgttagaaatagtaggtgctgcaccaggaactcacgctagtcaagattattttgccatttggagagattctgaagaatatagggaaatgcagaaagagttggactggatggaacgagaattgcctaaacggacggaaggttcgtcaaatgaggagcagaaggagttcgctacgtcaactttgtaccagatcaaattggtgagttatcgattattccatcaatattggagaacaccattttacttatggtcaaaatttttttcaacaattgtgtctgaactcttcataggcttcacttttttcaaggcgaatacatcattacagggcctacagaatcaaatgctggccatttttatgtttacagtggtattcaacccaatattgcaacaatatttaccacttttcgttcagcagagggaactttatgaagctagagaaaggccatcaagaaccttttcgtggaaagcatttattgtatcgcagattctcgtggaaatcccttggaatttactggccggtactatagcttttttcgtctattattatcctgttggattttacagaaatgcttcttatgcaaatcaacttcatgaacgaggagctttattttggttatttgcgtgcgcgttttacgtctacatcagttcaatgggggtattagtgatttcatgcattgaaattgcagaaaatgctgcgaatctcgcttcacttttctttataatgtcattatctttctgcggtgttctggctacgccaaatattctaccaagattctggatttttatgtatagagtatcgccactgacatacctcattgatgctctgctatcggtaggactggccaatgctagtgtcgtttgttccagcaacgaacttttaaaaattgttcctccaagcggtatgacatgctcggaatatatggaaccttatatgcaatccaccgggacgggttatctgctcgatgggagttccgaaactgaatgtcacttttgtcaattcagttctaccaatgattatctggcgactgtgagttcttcgtattcacgtagatggatgaactatggcatttttagtgcatatattgtctttgactattgtgcagcaatatttttatactggctggtgcgggttccaaagaaaagcaaaaaattaaagaaataa

SEQ ID NO: 164 - protein, 1564 aa, Saccharomyces cerevisiae
MLQAPSSSNSGLNQGNAAPDGPPNETQPYEGLDAAAQEEIKELARTLTSQSSLLSQEKRITGTGDPNTLTAASSSSLSRSIFASDIKGVNPILLDVNDPDYDETLDPRSENFSSVRWVRNMAQICENDSDFYKPFSLGCAWKDLSASGDSADITYQGTFGNMPIKYLKMSWRCISRRLFHRTHGKSEDNDSGFQILKPMDGCINPGELLVVLGRPGAGCTTLLKSISVNTHGFKISPDTIITYNGFSNKEIKNHYRGEVVYNAESDIHIPHLTVFQTLYTVARLKTPRNRIKGVDRDTFAKHMTEVAMATYGLSHTADTKVGNDFVRGVSGGERKRVSIAEVSICGSKFQCWDNATRGLDSATALEFIKALKTQATITKSAATVAIYQCSKDAYDLFDKVCVLYDGYQIFFGPSKQAKKYFQRMGYVCPERQTTADYLTSITSPSERIKDKDMVKHGIMIPQTAYEMNQYWIQSEEYKQLQVQVNKHLDTDSSQQREQIKNAHIAKQSKRARPSSPYTVSFFLQVKYILIRDIWRIKNDPSIQLFTVLSHAAMALILGSMFYEVMLSTTTTTFYYRGAAIFFAILFNAFSSLLEIFSLYETRPITEKHKTYSLYRPSADAFASTFSDVPTKLATAVTFNIPYYFLINLKRDAGAFFFYFLINIITVFAMSHLFRCIGSVSKTLPQAMVPASVLLLAFAMYTGFAIPRVQMLGWSKWISYINPLSYLFESLMINEFHGRNFPCAQYIPSGPNYVNATGDEVTCSALGSIPGNNYVSGDDFIQTNYGYRHKNKWRSVGIGLAYIIFFLFLYLFFCEYNEGAKQNGEMLVFPHSVVKKMKKKGIVSEKKKKNQPTLSTSDAEKDVEMNNNSSATDSRFLRDSDAAIMGNDKTVAKEHYSSPSSSASQSNSFSKSDDIELSKSQAIFHWKNLCYDIPIKNGKRRILDNVDGWVKPGTLTALIGASGAGKTTLLDCLAERTTMGLITGDVFVDGRPRDQSFPRSIGYCQQQDLHLKTATVRESLRFSAYLRQADDVSIEEKDKYVEEVIEVLEMKLYADAIVGVPGEGLNVEQRKRLTIGVELAAKPKLLVFLDEPTSGLDSQTAWSTCQLMKKLASRGQAILCTIHQPSALLMQEFDRLLFLQEGGQTVYFGELGKGCKTMINYFEAHGAHKCPPDANPAEWMLEIVGAAPGTHASQDYFAIWRDSEEYREMQKELDWMERELPKRTEGSSNEEQKEFATSTLYQIKLVSYRLFHQYWRTPFYLWSKFFSTIVSELFIGFTFFKANTSLQGLQNQMLAIFMFTVVFNPILQQYLPLFVQQRELYEARERPSRTFSWKAFIVSQILVEIPWNLLAGTIAFFVYYYPVGFYRNASYANQLHERGALFWLFACAFYVYISSMGVLVISCIEIAENAANLASLFFIMSLSFCGVLATPNILPRFWIFMYRVSPLTYLIDALLSVGLANASVVCSSNELLKIVPPSGMTCSEYMEPYMQSTGTGYLLDGSSETECHFCQFSSTNDYLATVSSSYSRRWMNYGIFSAYIVFDYCAAIFLYWLVRVPKKSKKLKK

SEQ ID NO: 165 - DNA, 4506 bp, Saccharomyces cerevisiae
atgagcaatatcaaaagcacgcaagatagctctcataatgctgtcgctagaagctcaagcgcttcttttgcagcttcagaagaatcatttacgggcataacccatgacaaagatgagcagagcgataccccggcggataaactaacaaaaatgctgacaggacctgcaagagacactgcgagccagattagtgccactgtgtctgaaatggcgccagatgtcgtatctaaagtggagtcatttgcagatgcactatcccgtcatacaacgagaagcggtgcctttaatatggattcagatagtgacgatgggttcgatgcccatgccatctttgaaagttttgtaagagacgctgatgagcaaggcatccatatccgcaaggctggtgttaccatagaggacgtaagcgctaaaggtgtggatgcgagtgccctagaaggtgctacctttggtaacattctttgtttaccgttgaccatctttaaaggtattaaggctaagaggcatcaaaagatgagacagatcataagcaatgtcaatgccctggcagaagcgggtgaaatgattttggttcttggaaggcctggtgctggttgttcctcctttttaaaagtaacagctggtgaaatagatcagtttgccggtggtgtttccggtgaagtagcatatgatggtattccccaagaagaaatgatgaaacgatataaagcagatgttatttacaatggtgagttggatgttcatttcccttatttaacagttaagcaaactttggatttcgctattgcctgcaaaacgcctgctctcagagtcaataacgtttccaaaaaggaatacattgcatccagaagagatttatatgcaaccattttcggtctaaggcatacctataataccaaagttggtaacgatttcgttagaggtgtatctggtggtgaacgtaagcgtgtttccattgccgaggctttggcagccaaaggttccatttactgttgggataatgccactagaggtttggatgcgtctacggccttagaatacgcaaaagccatccgtattatgacaaacttattgaaatcaaccgcttttgttacaatttatcaggcaagtgaaaacatttacgaaacatttgataaagtcactgtcctttattctggtaagcaaatttattttggtttgatccacgaggcaaaaccttatttcgcaaaaatgggttatttgtgtcctccaaggcaagcaacagctgaatttttaaccgcgttgactgatccaaatggattccatctgatcaagccaggttatgaaaataaagtaccaagaaccgctgaggaattcgaaacatattggttaaattctccagagtttgctcaaatgaaaaaagatatcgctgcttataaagagaaggtcaataccgaaaagactaaagaagtttatgacgaatcgatggctcaagagaaatccaaatatacgagaaagaagtcttattatacagtgtcatattgggaacaagttaaactgtgtacccaacgtgggttccaaagaatttacggtaacaagagttatacagtcatcaatgtctgctctgcaataattcaatcttttattactggatcattattttacaataccccttcatccacttccggtgctttttcaagaggtggtgtgttgtattttgcgctactatattattctttgatgggactggcgaatatttcttttgaacataggccaatcttacaaaagcacaagggctattctttgtatcatccttcagctgaggcaattggctccactctggcatctttccccttcagaatgattggtttgacctgtttctttatcattttattcttcctatctgggttgcacagaacagcgggatcattttttaccatctatttgttcttaaccatgtgttcagaggcgatcaatggtttatttgagatggtttcttcagtatgtgacactctttctcaagctaactctatctcgggtattctgatgatgtctatctcaatgtactctacctatatgatccaattgccttcgatgcatccatggtttaaatggatatcgtacgtactacctatcaggtacgccttcgagtcgatgttaaatgccgaatttcacggtaggcatatggattgtgctaacactctagtacccagtggaggagactatgataatttatccgatgactacaaagtatgtgcttttgttggttcgaaaccaggtcagtcttatgtgcttggtgatgactaccttaaaaatcaatttcagtacgtttataagcacacgtggagaaactttggtatcttgtggtgctttttactgggttatgttgttttgaaagtgatattcacagaatataagaggcctgtgaaaggtggtggtgatgctcttatcttcaagaaaggatcaaaaagatttatcgcacatgcagatgaagaatctccagacaatgtcaatgatatagatgccaaagagcaattctccagtgaaagtagcggcgcaaatgatgaagtatttgatgatttagaagccaaaggtgttttcatttggaaggacgtatgctttactattccatatgaaggcggtaagagaatgcttttggataatgtttcaggttattgtattccaggtaccatgacggccttgatgggagagtcaggtgctggtaaaacaactttgttaaatactcttgctcaaagaaatgtcggtatcattactggtgatatgcttgtcaatggacgtcccattgatgcgagtttcgaaaggcgtacaggttatgtacaacaacaggatatacatatcgcagagttaactgttagggaatcgttgcagttttctgctcgtatgcgtcgccctcagcatttgcctgattctgaaaaaatggattatgtggaaaaaatcatcagagttttgggaatggaagagtatgcggaagcccttgttggtgaggttggttgtggtttaaacgttgaacagagaaagaagctgtctattggtgttgaactagtcgccaaaccagacttattattattcctcgatgaacctacatcaggtttggattctcaatcttcatgggccattattcaattattaagaaagttatcaaaagctggccaatccattctttgtacgatccatcaaccttcagctactctgttcgaagagtttgatagattactacttttgaggaagggtggacaaactgtttatttcggagatattggtaagaactctgccaccattttgaactactttgaaaggaatggggcaagaaaatgtgattctagtgaaaatcctgctgaatatattttagaggctattggtgccggtgccacagcatccgtcaaagaagactggcacgaaaaatggttgaactctgtcgagtttgaacaaacaaaagaaaaagtacaggatttaataaatgatttatcgaaacaagaaactaaatccgaagttggagacaaaccttccaaatatgctacttcttatgcttaccagttcagatatgttttaatcagaacctctacttcattttggagaagtctgaattacatcatgtcaaagatgatgctaatgctggttggtggtctgtatattggtttcacatttttcaatgttggtaaaagttatgtcggcttacaaaatgcgatgttcgcggcatttatctctattatcttgtctgctcctgcaatgaaccaaatccaaggacgtgctattgcctccagagaactttttgaagttagggaatcccaatctaacatgtttcactggtcgctggtgttgatcactcagtacttgagcgaacttccctatcatttatttttttcgacaattttctttgtctcatcgtattttccattaagaatcttcttcgaagcgtcaagatctgcggtgtactttttgaattactgcattatgttccagttatactatgttggtcttggcttaatgatcctatatatgtcaccgaaccttccatccgctaatgttatcttaggtttgtgtctgtcatttatgctttctttctgtggtgttacacaacctgtctcattgatgcctggcttctggacattcatgtggaaggcttccccatacacatattttgttcagaatctggtcggaattatgctgcacaaaaaaccagtcgtatgcaaaaagaaagaactaaactacttcaacccaccaaacggctcaacgtgtggagagtacatgaaaccctttttggaaaaagctactggttacatcgaaaatcctgatgctacgtcagattgtgcatactgtatttacgaagttggagataattatttgacacatatcagctctaagtatagctacttgtggagaaattttggaatattttggatttacattttcttcaatatcattgctatggtttgtgtgtattacctcttccatgtaagacaatcttccttcctaagccccgtatctatactcaataaaattaaaaacataaggaaaaagaagcagtaa

SEQ ID NO: 166 - protein, 1501 aa, Saccharomyces cerevisiae
MSNIKSTQDSSHNAVARSSSASFAASEESFTGITHDKDEQSDTPADKLTKMLTGPARDTASQISATVSEMAPDVVSKVESFADALSRHTTRSGAFNMDSDSDDGFDAHAIFESFVRDADEQGIHIRKAGVTIEDVSAKGVDASALEGATFGNILCLPLTIFKGIKAKRHQKMRQIISNVNALAEAGEMILVLGRPGAGCSSFLKVTAGEIDQFAGGVSGEVAYDGIPQEEMMKRYKADVIYNGELDVHFPYLTVKQTLDFAIACKTPALRVNNVSKKEYIASRRDLYATIFGLRHTYNTKVGNDFVRGVSGGERKRVSIAEALAAKGSIYCWDNATRGLDASTALEYAKAIRIMTNLLKSTAFVTIYQASENIYETFDKVTVLYSGKQIYFGLIHEAKPYFAKMGYLCPPRQATAEFLTALTDPNGFHLIKPGYENKVPRTAEEFETYWLNSPEFAQMKKDIAAYKEKVNTEKTKEVYDESMAQEKSKYTRKKSYYTVSYWEQVKLCTQRGFQRIYGNKSYTVINVCSAIIQSFITGSLFYNTPSSTSGAFSRGGVLYFALLYYSLMGLANISFEHRPILQKHKGYSLYHPSAEAIGSTLASFPFRMIGLTCFFIILFFLSGLHRTAGSFFTIYLFLTMCSEAINGLFEMVSSVCDTLSQANSISGILMMSISMYSTYMIQLPSMHPWFKWISYVLPIRYAFESMLNAEFHGRHMDCANTLVPSGGDYDNLSDDYKVCAFVGSKPGQSYVLGDDYLKNQFQYVYKHTWRNFGILWCFLLGYVVLKVIFTEYKRPVKGGGDALIFKKGSKRFIAHADEESPDNVNDIDAKEQFSSESSGANDEVFDDLEAKGVFIWKDVCFTIPYEGGKRMLLDNVSGYCIPGTMTALMGESGAGKTTLLNTLAQRNVGIITGDMLVNGRPIDASFERRTGYVQQQDIHIAELTVRESLQFSARMRRPQHLPDSEKMDYVEKIIRVLGMEEYAEALVGEVGCGLNVEQRKKLSIGVELVAKPDLLLFLDEPTSGLDSQSSWAIIQLLRKLSKAGQSILCTIHQPSATLFEEFDRLLLLRKGGQTVYFGDIGKNSATILNYFERNGARKCDSSENPAEYILEAIGAGATASVKEDWHEKWLNSVEFEQTKEKVQDLINDLSKQETKSEVGDKPSKYATSYAYQFRYVLIRTSTSFWRSLNYIMSKMMLMLVGGLYIGFTFFNVGKSYVGLQNAMFAAFISIILSAPAMNQIQGRAIASRELFEVRESQSNMFHWSLVLITQYLSELPYHLFFSTIFFVSSYFPLRIFFEASRSAVYFLNYCIMFQLYYVGLGLMILYMSPNLPSANVILGLCLSFMLSFCGVTQPVSLMPGFWTFMWKASPYTYFVQNLVGIMLHKKPVVCKKKELNYFNPPNGSTCGEYMKPFLEKATGYIENPDATSDCAYCIYEVGDNYLTHISSKYSYLWRNFGIFWIYIFFNIIAMVCVYYLFHVRQSSFLSPVSILNKIKNIRKKKQ

SEQ ID NO: 167 - DNA, 4536 bp, Saccharomyces bayanus
atgtccgagacaaagctcaccagtaacgtcaatggcgtcagcagctactcctccgcttcatcctccactgaaaacgatgctgatctgcatgagtacaatggatttgatgagcagacggaagctcgcatccagaacctggcaagaactttgactgctcagagtgcgcagcactcgatccaatccgcatccaacaaacaagatgctcaatctatcttctccagtggcgtggatggtgtcaacccggtcttcaccgaccctcaagccccaggctataacgcacaattggatcctaattccgaaaacttctccagtgccgcttgggttaaaaacatggcccgtttaagtgcggctgacccagagttttataaaccatattccttgggttgcgcctggaaaaacttgagtgcctcaggtgattctgctgatgtcgcataccaacccaccgtgttcaatgccccatacaaattaattaaaaatgccacgagaatattccaaaattcaaatgaaggtagcactttccagatcttgaaacccatggagggctgtctaaacccaggcgaactattggtcgttttgggtagaccaggttctggttgtaccactctattgaaatccatttcctcgaatactcacggttttgatcttggcaaagacacagaaatctcctacagtgggtactccggcgatgatataaaaaaacattatcgtggtgaagtcgtttacaatgcagaagctgatatccatttacctcatctaacagttttccaaaccttacttacagtcgctagattaaagacccctcaaaatcgtataaagggtgtagacagagaaagttatgctaaccatctggctgaagtcgctatggctacctatggtttatctcataccagaaataccaaggtcggtagtgatttagtcagaggtgtctccggtggtgaaagaaagcgtgtttccatcgctgaagtctccatttgtgggtctaagttccaatgttgggataatgctacaagaggtttggattccgctaccgctttggagttcatccgtgctttgaaaattcaagccaacatttctaacacctctgccactgtggctatctaccaatgttctcaagatgcatacgatctatttaataaagtgtgcgtcttagatgacggttatcaaatttattatggcccaggtgataaggccaagaaatatttcgaagatatgggatacgtgtgtccaagtagacagacaactgctgatttcttgacctccgtgaccagtgtctcagaaagaatactgaacgaagacatgttgaaaaaaggcatcagcatcccacaaacaccaaaggacatgaacgattactgggtgaagtcccagaactacaaagaattaatggaagaaatcgatcaaaaaattaataataacgatgaagccgcccgtgaagcaatcaaggaagctcacattgctaaacaatcaaatagagcaagacccacctctccttacactgtcaattatatgatgcaagtcaaatacctactggcgagaaatatgtggagaatacgaaataatattgggtttacattattcatgatcttaggtaattccggtatggctttgattttgggttccatgttttacaaaattatgaaaaacggtgacacttctactttcttcttccgtggttctgctatgttttttgccatcttgtttaatgcgttctcttctttactggaaattttctcgttatatgaagctaggtcaattactgaaaagcatagaacttactctttataccatccaagtgcagatgccttcgcatcagtactttccgaagtccctacaaagctcaccattgctgtttgtttcaacatcatcttctatttcttagttgacttcagaagaaacggtggtgttttctttttctacctattaattaacatcgttgctgttttctctatgtctcatttgtttagatgcgttggttcgctaacaaaaacattatcagaggctatggttcccgcttctatgttactgttgtctctgtctatgtacaccgggtttgcgattccaaagaagaagattttaggatggtctaaatggatttggtatatcaacccactggcttacttattcgaatctttgttaatcaatgaatttcacgatagaaaatttccatgtgctcaatatattccccgtggtaccgcttatgcgaattcaacgggtacagaaactatctgtagcgtggttggtgccattcctggccaagattatgtgtcaggagatgatttcatcaaagaaagttaccaatattaccatagccacaaatggcgtggattcggtattggtatggcgtatgttattttctttttcttcgtttatctattcctatgtgaatataatgaaggtgctaaacaaaaaggtgagattttagttttcccacgtagtgttgtgaagaagatgaagaaacaaggtgccttgaaagagaaaaatggtaacgatcctgaaaatgttggtgaacgtagcgatttttctagtgacaaaaaaatgctacaagaaagttccgaagaagaatccgatacttatggggacgttggtttatccaagtctgaagctattttccactggagaaatttgtgttacgaagtccagattaaaaccgaaacaagacgtatcttgaacaacgttgatggctgggttaaaccaggtactttaactgctttaatgggtgcttccggggccggtaaaaccaccctattggattgtttagctgacagagtgaccatgggtgtcataactggtgatatatttgttaatggtatccctcgtgatgaatctttcccaagatccattggttactgtcaacaacaagatttacacttgaaaactgccactgtgagagaatcgttaagattctctgcatatttacgtcaacctgctgaagtctccattgaagagaaaaatgtctacgttgaagaagttatcaagattttggaaatggagaagtatgccgatgctgttgtcggtattgctggtgaaggtttaaatgttgagcaaagaaaaagattgaccattggtgttgaattaactgcaaagccaaaacttttagtctttttggatgagcccacatctggtttagattctcaaactgcctggtctatttgccagttgatgaaaaaactagcaaaccatggtcaagccattctttgtaccattcatcaaccttctgctattttgatgcaagagtttgaccgtttgctatttatgcaacgtggtggtaagacagtttactttggggacttaggcgatggttgcaagactatgattgattattttgaaaaccatagttcacataagtgtcctcctagtgccaacccagctgagtggatgttggaagttgtgggtgctgctcctggtactcatgccgaccaagattatcatgaggtttggagaaattctgatgaatacagagctgttcaatctgaattagattggatggaaaaggaattaccaaagaagggtcctattactgctgaagctgaccaacatgagtttgctcaatcaatcgtttatcaaacaaaattggtcagtattcgtttattccaacaatattggagaacccctgcttatttatggtccaaatttatcctgactattttcaatcagttgtttatcggtttcacatttttcaaggctgggacctcactacagggtttacaaaatcaaatgttagcagtttttatgttcacagttattttcaatcctattttgcaacaatacttaccttcctttgtgcagcaaagagatttatatgaagcaagagaacgtccctcaagaaccttttcttggctaccatttatacttgctcagattttcgtggaagttccatggaatattttagcgggtacagttgcttatttcatctattactacccaattggcttctattcaaatgcctcagctgctcatcagctgcacgaaagaggtgctctgttttggctattctcctgtgctttctatgtttacgtgggttcaatgggtttgctcgttatatctttcaacaaagttgctgaaagtgctgctaatctcggttctttgctatttactatggcgttgtctttctgtggtgttatggtaaccccagataatctacctagattttggatttttatgtacagagtatcaccgttgacttacttcattcaagctctcttgtctgttggtgtcgcaaacgtggacgtcaagtgtgatgattacgagctcttacaattttcacctccatccgatatgacttgtggccaatacatgaagccgtatctactggaggttggtaccggttatttgactgatgaaagtgcaactgacacttgtagtttctgccagatttctacaacaaacgcttacttagccagcgtcaattcatattacggtgacaggtggagaaattacggtatcttcatttgctacattggctttaactacatcgcaggtgtctttttgtactggttagcaagagtgcccaagaagaacaagaaactctctaagaattag

SEQ ID NO: 168 - protein, 1511 aa, Saccharomyces bayanus
MSETKLTSNVNGVSSYSSASSSTENDADLHEYNGFDEQTEARIQNLARTLTAQSAQHSIQSASNKQDAQSIFSSGVDGVNPVFTDPQAPGYNAQLDPNSENFSSAAWVKNMARLSAADPEFYKPYSLGCAWKNLSASGDSADVAYQPTVFNAPYKLIKNATRIFQNSNEGSTFQILKPMEGCLNPGELLVVLGRPGSGCTTLLKSISSNTHGFDLGKDTEISYSGYSGDDIKKHYRGEVVYNAEADIHLPHLTVFQTLLTVARLKTPQNRIKGVDRESYANHLAEVAMATYGLSHTRNTKVGSDLVRGVSGGERKRVSIAEVSICGSKFQCWDNATRGLDSATALEFIRALKIQANISNTSATVAIYQCSQDAYDLFNKVCVLDDGYQIYYGPGDKAKKYFEDMGYVCPSRQTTADFLTSVTSVSERILNEDMLKKGISIPQTPKDMNDYWVKSQNYKELMEEIDQKINNNDEAAREAIKEAHIAKQSNRARPTSPYTVNYMMQVKYLLARNMWRIRNNIGFTLFMILGNSGMALILGSMFYKIMKNGDTSTFFFRGSAMFFAILFNAFSSLLEIFSLYEARSITEKHRTYSLYHPSADAFASVLSEVPTKLTIAVCFNIIFYFLVDFRRNGGVFFFYLLINIVAVFSMSHLFRCVGSLTKTLSEAMVPASMLLLSLSMYTGFAIPKKKILGWSKWIWYINPLAYLFESLLINEFHDRKFPCAQYIPRGTAYANSTGTETICSVVGAIPGQDYVSGDDFIKESYQYYHSHKWRGFGIGMAYVIFFFFVYLFLCEYNEGAKQKGEILVFPRSVVKKMKKQGALKEKNGNDPENVGERSDFSSDKKMLQESSEEESDTYGDVGLSKSEAIFHWRNLCYEVQIKTETRRILNNVDGWVKPGTLTALMGASGAGKTTLLDCLADRVTMGVITGDIFVNGIPRDESFPRSIGYCQQQDLHLKTATVRESLRFSAYLRQPAEVSIEEKNVYVEEVIKILEMEKYADAVVGIAGEGLNVEQRKRLTIGVELTAKPKLLVFLDEPTSGLDSQTAWSICQLMKKLANHGQAILCTIHQPSAILMQEFDRLLFMQRGGKTVYFGDLGDGCKTMIDYFENHSSHKCPPSANPAEWMLEVVGAAPGTHADQDYHEVWRNSDEYRAVQSELDWMEKELPKKGPITAEADQHEFAQSIVYQTKLVSIRLFQQYWRTPAYLWSKFILTIFNQLFIGFTFFKAGTSLQGLQNQMLAVFMFTVIFNPILQQYLPSFVQQRDLYEARERPSRTFSWLPFILAQIFVEVPWNILAGTVAYFIYYYPIGFYSNASAAHQLHERGALFWLFSCAFYVYVGSMGLLVISFNKVAESAANLGSLLFTMALSFCGVMVTPDNLPRFWIFMYRVSPLTYFIQALLSVGVANVDVKCDDYELLQFSPPSDMTCGQYMKPYLLEVGTGYLTDESATDTCSFCQISTTNAYLASVNSYYGDRWRNYGIFICYIGFNYIAGVFLYWLARVPKKNKKLSKN

SEQ ID NO: 169 - DNA, 2220 bp, Kluyveromyces waltii
atggttgacagtgtcgccagcagtcaggaggcatatacaggcttagacggaaacgccctggaacatgtgcgcgaactggcgcgcacattcaccaacgtttcagaacaaactacgcctggtctaaatcctgtttttactaacacacagtctgcgtcttatgacccagaattggacccaaactccgagtcgttctcatcggctgcctgggtacgcaacttaagcaaagtcgtggatagtgatccagatcattataaaccttattctctgggatgcgcatggacaaacttacgcgcctatggtgattctacagatgtagcctaccagtcgacagtagctaacctgccactcaagtttgctgaattcgtctatcgtaaggcgcgcaaagcgcgtcctgcggactcgttcgacattttgaagccgatggatgggttggtcaatccaggtgaacttctcgtcgttttgggtcgtcccggttctggttgctctaccttactcaaatcgatctcatccaatacccatggatttcatattggcgaggagtctactgtttcttacgatggcctcacgcccaaagaaatcagtaaacacttcaggggtgaggttgtctacaacgcggaagctgacattcactttccgcatttaactgtctttcagaccctcaacacaatcgcccttttatctacaccagctaatcggatacctggcgtggaccgggagacatttgctaagcacgtgacagaggttaacatggccacctacggtttacttcacaccagaaacaccaaagttggtaacgaattggtcagaggtgtctctggtggagagcgtaagcgtgtttctattgccgaggtagcaatttgtggttctaaattccaatgttgggacaatgcaacgagaggattagactccgccaccgcactagagtttgttagagctctgcgcacgaacaacaaaatgaccgattcttcaggtgcggttgccatataccaatgttcccaagatgcctacgagctttttgataaggtttgcgtattgcatgaaggttatcagatttattttggtcctgtcgacgaggccaaagaatactttgaacaaatgggctacgtttgtcctagccgtcaaacaaccgctgacttcctcacagctgtcactagcccttctgagagaatcgtaaacgagaattttaccaatgttccatctacagctgtagaaatggagaaatactggaaaaactcggagaactacaagcggcttcgagcagagatcgaagcatacaatgcccaggatttcaacgagaaaaggaatcagctcgaggaagcacataccgccaagcaatctaatggggctagagcctcatcaccctacaccgtcagctatggaatgcaggtcaagtacttactccaaagaaatttcatgagaattcgtaataatataggcttcacggcctttcaaatcattggaaatggtgccattgctttcattctaggttctatgttttacaaagttttaaaacatgataccacgagtggtttctattcacgcgctggcgcactctttttcgccgtgctgtttaatgccttttcctgtatgctggaaattctggcattatacgaagcaagaccgatctcagagaagcataaacgttactcactatatcatccttcagcggatgccttggcgtctataatttccgaaatccctgcgaagatcatcacatcaatcgttttcaacatcgccctttacttcctctgcaacttcaaaagagaggcaggcgcttttttcttttaccttttaatgaccatgatagcaaccttgttcatgtctcatattttcagatgcttggggtcagcaacaaagacatttgccgaagctatggtgccggcatccgtgatattactcgcgatgtccatttacactggttttgcaattcccaaaaccaaaattttagggtgggccaaatggatctggtatattaatccactatcttacgttttcgaatctttaatggtcaatgaatttcatggccgtagatttgcgtgctcaaattttgttcctaatggtccaggttacaatggcatttcaggtgttgaaagagtatgttccgcggtcggtgcagaagcgggtgcagactttgtaaatggtgagaaatacatcaacgtggcttacggttattatcatgcgcataagtggcgtggttttggcattggactaggttatgcc

SEQ ID NO: 170 - protein, 740 aa, Kluyveromyces waltii
MVDSVASSQEAYTGLDGNALEHVRELARTFTNVSEQTTPGLNPVFTNTQSASYDPELDPNSESFSSAAWVRNLSKVVDSDPDHYKPYSLGCAWTNLRAYGDSTDVAYQSTVANLPLKFAEFVYRKARKARPADSFDILKPMDGLVNPGELLVVLGRPGSGCSTLLKSISSNTHGFHIGEESTVSYDGLTPKEISKHFRGEVVYNAEADIHFPHLTVFQTLNTIALLSTPANRIPGVDRETFAKHVTEVNMATYGLLHTRNTKVGNELVRGVSGGERKRVSIAEVAICGSKFQCWDNATRGLDSATALEFVRALRTNNKMTDSSGAVAIYQCSQDAYELFDKVCVLHEGYQIYFGPVDEAKEYFEQMGYVCPSRQTTADFLTAVTSPSERIVNENFTNVPSTAVEMEKYWKNSENYKRLRAEIEAYNAQDFNEKRNQLEEAHTAKQSNGARASSPYTVSYGMQVKYLLQRNFMRIRNNIGFTAFQIIGNGAIAFILGSMFYKVLKHDTTSGFYSRAGALFFAVLFNAFSCMLEILALYEARPISEKHKRYSLYHPSADALASIISEIPAKIITSIVFNIALYFLCNFKREAGAFFFYLLMTMIATLFMSHIFRCLGSATKTFAEAMVPASVILLAMSIYTGFAIPKTKILGWAKWIWYINPLSYVFESLMVNEFHGRRFACSNFVPNGPGYNGISGVERVCSAVGAEAGADFVNGEKYINVAYGYYHAHKWRGFGIGLGYA

SEQ ID NO: 171 - DNA, 4425 bp, Kluyveromyces waltii
atggaggacctcgttgatactgatcaagggtcttatgcggggttcgacaggcttgcacaggaccgtgttcagggactcgcaaagacactaactaatgggtccagcttcgtggaccgatcagccggtaatttgaatcctttttcttcaagcattggtggcgcgggctatgacccaaaactcgatcccaactcagactctttctcctcggtagcatggatgcgaaacttgaacaaaatcgtcacaagtgatccagaattctacaagccatactcacttgggtgttcgtggaccaacctccgcgcgtatgggagttcgatggacgtgacgtaccagtccacggttgctaatttgccgctcaaaattgccgagtttgcgtaccgctgtgcgcgcaaagcgcgcccagcggatactttcgacattttgaagcccatggacggactaattaaaccaggggagctcctagttgtactaggtcgtcccggctctggctgctccacgcttttgaaatccatttcctccaacacccatggcttccatatcgacaaagaatctcacatttcatacgacggaatgagtccgatggagatccataaacactacaggggagaagtggtctacaacgccgaggcagacgtgcacttcccccacctgactgttttcgaaacgctgaatattgcagctcttctttcgacccccgcaaaccgcgtgcctggcgtggatcgtgaagcatttgccaatcacgtgaccgaggtaaccatggcgacctacggtttattgcatgccagagataccaaggtgggcaacgagttggtcagaggtgtatctggcggggagcgcaagcgtgtttccattgccgaagtatctatttgtgggtctaaatttcagtgttgggacaatgcgacccgaggtctagattctgccactgcgcttgagtttgtgaaggccctggaaacaaacgctaaaatgacaagttcctctgctgccatcgcaacctatcaatgttcccaagacgcctacgatctctttgacaaggtatgcgttttgcatgaaggttaccagatttttttcggccccgccaacgaagggaaaaagtactttgaagacatgggctacatttgccctgataggcaaactactgctgactttctaacggctgttaccaatcccgcagaaaggatagtgaataagagtttctcttatgtgccctccacagcctcggaaatggagatccattggaagaattctgaaaactacaagcgcctgtgcgacgagattgaaagttacagggcccaaaagctcgatgaaaaaaagcatcaactacgcgaagcacatatctccaagcagtctaaacatgcgagaagtgcatccccttacacagtcagctacggcttacaagtcaaatatctcttgagaagaaactttatgagaatccgcaacagcatgggcctcaccgtgttcacaatcgtcggtcatgggggaatcgcctttgtattgggctccatgttttacaaggttcttaaacacaataccactgacagtcttttttcgcgcgcaggagctctatttttctcagtcctcttcaatgcattttcatgtatgcttgaaatcctggccttgtacgaggcaagaccaatctccgagaagcacaaaaggtactcactatatcatccttctgcagacgcgctggcttcgattatatctgaaattcccacaaaaattgcagtagcgaccactttcaatatcgcgatgtattttctgtgcaatttcaagagagacgcaggtgcattcttctttttcttcatgatgaatctattggcaacgtttgtcatgtcacatatcttcaggtgtttgggttctgcaaccaagacctactccgaatccatggtcactgcgtccgtcattttgctagctttatccatctacacaggatttgcaataccaaaaaccaagatattgggctgggcaaaatggatatggtatattaaccctttgtcatacatctttgaatcattaatggtcaatgaattccacggccgagaatttcaatgctcaaattttgtacctgccgggcctgcttatgtgggtagttcaggaactgaacgggtctgctctgctgtggggtctgaggctggattgagtgttgtacatggtgagaggtacatcaatctgagctatggctactaccatgctcataagtggcgcggcttcggtatcggattggcttacgctatttttttcctcggcgtatacttggcttttacagagttcaatgaaagcgccaagcagcgtggtgaggtgttagtttttactcgttcgaccatgaaaaggataaaaaagggaatcacagtcctgaatgatgtggaaaatgacgctggagctcagtctgctactgaaaagagacttttcgatgatactactgaagtaggtagctcaatttccgtattgggcaatgtgcaactgtcaaagtcggaagcaatcttccattggaagtctttatgctatgatgtccccatcaaaggtggtaccagaagaattttggatcatgttgacgggtgggtcaaaccgggtactttgacagctctaatgggcgcgtctggtgcaggaaaaactacacttttagactgcttagcctcaagagtcaccactggcgttgttaccggtgatattcttatcaatggcaacaaacgggatgcttcttttgctcgatctattggctactgccagcaacaagacttgcatttgcagaccgcgacagttcgagagtccctgaggtttgctgcgcacttacgtcagcctcaatctgttccgagctcggaaaaagacaagtacgttgatgaggtcatcaagatcttggaaatggaaaaatacgctgacgctgtcgttggtgtggccggcgaaggattgaatgtagagcagcgtaaaagactcactattggtgtggaattggcggctagaccaaaattactgcttttcttggatgagcctacgtcgggtctggattcccagacagcttggtctatctgtcaactgatgcgaaagttagcaaatcacgggcaagctattctctgcactattcatcagccatcagccttactaatgcaggaattcgacaggctcctttttctgcagcgcgggggtcaaacggtttattttggggagttgggtgacgggtgtcaaacgatgattgactactttgaaaagcacggatctcagccttgcccgccaggtgcaaaccctgcagaatggatgctggaagtaatcggcgcagctccagggtctcacgcggagcaagattaccatgtagtatggaaaaattctgaggagaataaagctgtgcacagagagcttgatagaatggagacggaattcgaaaacatgccttcagggactgtcgatgattcagaattttcagcttcactaacttatcagtatgcgttggttactagaagattgctaactcagtactggaggactccatcctacctttggtcgaaattaatcctcacggctttttctcaactattcatcggattcacctttttcaaagcagacaattctttacaagggttacaaaaccagatgttgtctgttttcatgtttacgatcatattcaatccctcgctgcagcaatacttgcccacgtttgttgcccaaagaaacctgtacgaggccagagagcgtccttcaagaacgttctcatggttggcttttattttgtcacagataacagttgaaattccctggaactttgcaatagggacgcttgggttcctctgttattattatccagtcagtttttacagaaatgcatcgttcgcgggccagttgtctgaaaggggagctttgttctggctcttttgtaccgcgttctatgttttcacgggctcgatggcccagctatgtgtagctgccgccgaggtagccgattccgctgctcaacttgcggtcctactcttcacggtggcgctttcattctgtggtgtaatggtggcacccggtaatatgcctgggttctggattttcatgtacagagtctccccactcacgtacttcgttgatggtgtacttgcaactggaatagccaatgctaaagctcattgctctgcttatgagctagtatcattccaaccaccttctgggcaaagctgtggcgattacatgtcgccatatatcactgatgcgggcactggctatatcactaatccaaatgcaactgaaaactgctccttctgttctatttcaaccaccaatgcctacctgtcagctgtaagttctaactacaaacacaggtggagaaattacggtattttcttgtgttatattttcttcaatttcggtatggccatcttcttgtactgggttgcaagagtgcccaagaagagggaccgggtggtgaatgagaaggattcgtgtgtcgaagaataa

SEQ ID NO: 172 - protein, 1474 aa, Kluyveromyces waltii
MEDLVDTDQGSYAGFDRLAQDRVQGLAKTLTNGSSFVDRSAGNLNPFSSSIGGAGYDPKLDPNSDSFSSVAWMRNLNKIVTSDPEFYKPYSLGCSWTNLRAYGSSMDVTYQSTVANLPLKIAEFAYRCARKARPADTFDILKPMDGLIKPGELLVVLGRPGSGCSTLLKSISSNTHGFHIDKESHISYDGMSPMEIHKHYRGEVVYNAEADVHFPHLTVFETLNIAALLSTPANRVPGVDREAFANHVTEVTMATYGLLHARDTKVGNELVRGVSGGERKRVSIAEVSICGSKFQCWDNATRGLDSATALEFVKALETNAKMTSSSAAIATYQCSQDAYDLFDKVCVLHEGYQIFFGPANEGKKYFEDMGYICPDRQTTADFLTAVTNPAERIVNKSFSYVPSTASEMEIHWKNSENYKRLCDEIESYRAQKLDEKKHQLREAHISKQSKHARSASPYTVSYGLQVKYLLRRNFMRIRNSMGLTVFTIVGHGGIAFVLGSMFYKVLKHNTTDSLFSRAGALFFSVLFNAFSCMLEILALYEARPISEKHKRYSLYHPSADALASIISEIPTKIAVATTFNIAMYFLCNFKRDAGAFFFFFMMNLLATFVMSHIFRCLGSATKTYSESMVTASVILLALSIYTGFAIPKTKILGWAKWIWYINPLSYIFESLMVNEFHGREFQCSNFVPAGPAYVGSSGTERVCSAVGSEAGLSVVHGERYINLSYGYYHAHKWRGFGIGLAYAIFFLGVYLAFTEFNESAKQRGEVLVFTRSTMKRIKKGITVLNDVENDAGAQSATEKRLFDDTTEVGSSISVLGNVQLSKSEAIFHWKSLCYDVPIKGGTRRILDHVDGWVKPGTLTALMGASGAGKTTLLDCLASRVTTGVVTGDILINGNKRDASFARSIGYCQQQDLHLQTATVRESLRFAAHLRQPQSVPSSEKDKYVDEVIKILEMEKYADAVVGVAGEGLNVEQRKRLTIGVELAARPKLLLFLDEPTSGLDSQTAWSICQLMRKLANHGQAILCTIHQPSALLMQEFDRLLFLQRGGQTVYFGELGDGCQTMIDYFEKHGSQPCPPGANPAEWMLEVIGAAPGSHAEQDYHVVWKNSEENKAVHRELDRMETEFENMPSGTVDDSEFSASLTYQYALVTRRLLTQYWRTPSYLWSKLILTAFSQLFIGFTFFKADNSLQGLQNQMLSVFMFTIIFNPSLQQYLPTFVAQRNLYEARERPSRTFSWLAFILSQITVEIPWNFAIGTLGFLCYYYPVSFYRNASFAGQLSERGALFWLFCTAFYVFTGSMAQLCVAAAEVADSAAQLAVLLFTVALSFCGVMVAPGNMPGFWIFMYRVSPLTYFVDGVLATGIANAKAHCSAYELVSFQPPSGQSCGDYMSPYITDAGTGYITNPNATENCSFCSISTTNAYLSAVSSNYKHRWRNYGIFLCYIFFNFGMAIFLYWVARVPKKRDRVVNEKDSCVEE

SEQ ID NO: 173 - DNA, 4548 bp, Zygosaccharomyces rouxii
atggaaaagggaatggctagtgatgaagcagattcggcaacgcctatctcctatgaggacaatagtgttgttggtatcactgcaaatgccgatggtactggcgttgagacggatagagtagagagagcccctcaacagaacgctcttaataatgaggatggtggtaaattacatgaaatgttgacgaggaataggagcaatggtcaaggttcgcagttttctcctgaggttacttctaaagttcagtctttagcgagaacactttcaaagcatagactatcggatggatcgttagatttaccatcgggagatgatgaagatggattcaatgcagaaaggatcttacgccattttgtaaaggatgctaattcacaaaatatcgatttcagaaaaacaggtgtgactatggaagacgtatcggcaaccggtattgatactacgtctctagaaggttcgacgtttgcagatctcgtattgctgccctataccatcgtaagagctatctacaagaaaagacatcaacgtatgaggaagattcttcaaaatataaacgttttggcaaagccaggggaaatgattttagttttgggtagaccaggttcaggatgttcatcctttctaaaaactgcagccggggtgactgatcagtttgccggtggtgtcgatggtgaaattttatacgacggaattccacagaatgttatgatgaaaaattataagagcgatgttatctacaatcccgagttagatgtgcatttcccctttttgacggtcaaacagactttagattttgccattgcgtgtaagacaccagcggttagagttaacaacgtctctaggaaagagcatatccgtgctacacgtgatctgtatgcaaccatttttggcctaactcatacctatgatactaaagttggtaacgattttgtacgtggtgtttccggtggtgaaagaaaaagggtttccattgcagaggccttagcggctagaggtactgtttatagttgggataatgctacaagaggtttagatgcatccactgcgttggaatatgcacaagctatccgtatcatgacaaatttgttgaggtctacagcctttgttacaatttatcaggcaagtgaaaacatttatgaaacttttgataaagttacggtcttgcacagtggtagacagatttactacggatctacaaaagatgcaaaggattattttgccagaatggggtacttatgcccacctagacaagcaaccgcagaattcttaactgcattaactgatcctaacgggtaccataagattcgttcaggttttgaaaataaagttccacgtactgcagaggaatttgaagactattggttgcaatctccagagtttactgaactaaggaaggaagttcaagagtacaacgctaaggttaattctgatgcaacacaacaattcttttctgctactatgaaggctgaaaaatctaaattttccagaaacaaatcctattataccatttcatttcctgaacaagttagactttgtactgttagaggacttcaaagaatttatggtaataaggcttataccgttattaacgttgtggctgctgtcattcaagcttttattacaggttctgccttttacaattcaccatcttcaacagcaggagctttttctcgtggtggtgttctctacttttccctattgtattactctttgatgggtttagcaaacatttcttttgatcatagacccattttacaaaagcataagacatattcattgtaccatcctgcagctgaagccctaggttctactttctctggtacacctttccgactaattggtctaacccttttcattattattctttttttcctgtccggtttgaatagaactgctgctactttcttcagaatttatttgttccttgccatgtgtactgaatgtatctatgcattatttgattttattgcagctgcatgtgatgatattgcacaggcaagttccatttcaggtttgatcatgttttccctttcgatgtattccacctatatgattcaattgcccaacatgcatccttggttcaaatggatttcctatgtgttgccaatcagatatgcttttgaagctatgcttgaagctgaatttcacggtagacatatgtcatgtggttcaggatcactagtcccatcaggtcctggttatgaaaatgttacagattcgcatagagtttgtgcatttattggatctaaaaagggacagtcctgggttttgggtgacgattatttgtatgctcaatatacatacaaatattggcacgtatggagaaacttgggtattatgttcgcctttttaatcggttacgttgcggttaaagcaattataacagagattaaacgtccagtgacaagtggtggtgaagctctaatctttaagaaaggcgctagaagatctcttgataagcaaaagaacactgcgcaagacctagaagctatggatcaaatgaacatgcaggaagtaagggaaaaaatatctagtaacagtagtgatgttactcgtaatgatgagcaaaattccggagccattgagggatttggtagtaaaggtgtttttatttggcaggatgttcgttatgtgattccatatcagggcactgaaaagattcttttggataatgttactggttatgttgcgccagggaccatgacagctttaatgggtgaatctggtgcaggtaaaactactttattaaacactttggctaaacgtgccaacgttggtatagtgacgggtgatatgtcaatcaatggtaaaccagtagatagcagttttgaaagaagaaccggttatgtgcaacaacaagatattcacattgctgaaatgacagttagagaatccttggttttttcagctcgtttgagaagacctcaaagcattcctgacgcggagaaagttgcagatgcagagactgttatgaagttgttggatatggaggaatacggtgatgctctagttggtggcctaggcgcaggtttgaatgtggaacaaagaaagaaattatcaattggtgtggagttggtagctaagcctgaccttttgcttttccttgatgaaccaacttcaggcttagattctcaatcttcatgggccattgttcaacttttgagaagaattgctaaagctggacaatgtattctttgtaccatccatcaaccttctgctactttgttcgaacaatttgataggctattattgttgaaaaaaggtggacaaactgtgtactttggtgacattggtgaaaattcttctattgtgctagattactttgagagaaatggtgctagacattgtgaacaaagggaaaatcctgctgaatatgtcttagaggccattggtgcaggcgctacggcttctgtcaaggaagattggcacgagatttggcagagatctgaagagtgtagagcgacagatcagaaagtagctgagtggatacaagaattatctactcaagatttcgatgtcggtgaagttggtgaaaagagttccaaatatgctaccaattatttttaccaattcaaatatgtgtggatgagaacaaatctcacgctttacagagatttacgttacattttttccaaatttatgttacaaatcatgtctggtctttatatcggttggactttttacaatcctggtaaaagttatgtaggcttacaagataccctgttcgccgcattcgtatcagttattgtctccgcaccttccatgaaacaaattcaggcaagagcgttagcttctcgttcattatttgaagttcgtgaatccaaatccaatatgttccactggtcactgttgcttctaactcaatatttggcagaaattccgtatcatatattattctctaccatgtttttctgtgctttctatttcccattaagagtttggtttgaagcttccagatcagcagttttcttcttgaactactgcatcatgttccaattgttctatgtgggtttgggtctcatgattctttatatggctcctaatttaccatccgcgaacgttatcatggggttaattctatctatgatgattcaattttgtggtgtgacacaacctatgagtttgatgcctggattttggaccttcatgtggaaggcttccccttatacctatttcattcaaaatttggtagccattgtgttacacaaaaaaccagtggtttgcaagaagaaggaactcaactattttgacccacctcaaggtaagacttgtggtgaatacatgcatactttcttaaagcgcagtcaaggttacattgccaatcctgatgcaacttctaattgcgcttactgtcaagtatctgttggcgacgaatatttgtcacaaagaggtgtttcctacgggaatatttggagaaactttggattttactgggcttatatcatcttcaacctatttgctatggtgggcgtctattatatcttctctgtgagaggtctaagaagttttaatccattcttattcattaagaggattatcaagcgccagtaa

SEQ ID NO: 174 - protein, 1515 aa, Zygosaccharomyces rouxii
MEKGMASDEADSATPISYEDNSVVGITANADGTGVETDRVERAPQQNALNNEDGGKLHEMLTRNRSNGQGSQFSPEVTSKVQSLARTLSKHRLSDGSLDLPSGDDEDGFNAERILRHFVKDANSQNIDFRKTGVTMEDVSATGIDTTSLEGSTFADLVLLPYTIVRAIYKKRHQRMRKILQNINVLAKPGEMILVLGRPGSGCSSFLKTAAGVTDQFAGGVDGEILYDGIPQNVMMKNYKSDVIYNPELDVHFPFLTVKQTLDFAIACKTPAVRVNNVSRKEHIRATRDLYATIFGLTHTYDTKVGNDFVRGVSGGERKRVSIAEALAARGTVYSWDNATRGLDASTALEYAQAIRIMTNLLRSTAFVTIYQASENIYETFDKVTVLHSGRQIYYGSTKDAKDYFARMGYLCPPRQATAEFLTALTDPNGYHKIRSGFENKVPRTAEEFEDYWLQSPEFTELRKEVQEYNAKVNSDATQQFFSATMKAEKSKFSRNKSYYTISFPEQVRLCTVRGLQRIYGNKAYTVINVVAAVIQAFITGSAFYNSPSSTAGAFSRGGVLYFSLLYYSLMGLANISFDHRPILQKHKTYSLYHPAAEALGSTFSGTPFRLIGLTLFIIILFFLSGLNRTAATFFRIYLFLAMCTECIYALFDFIAAACDDIAQASSISGLIMFSLSMYSTYMIQLPNMHPWFKWISYVLPIRYAFEAMLEAEFHGRHMSCGSGSLVPSGPGYENVTDSHRVCAFIGSKKGQSWVLGDDYLYAQYTYKYWHVWRNLGIMFAFLIGYVAVKAIITEIKRPVTSGGEALIFKKGARRSLDKQKNTAQDLEAMDQMNMQEVREKISSNSSDVTRNDEQNSGAIEGFGSKGVFIWQDVRYVIPYQGTEKILLDNVTGYVAPGTMTALMGESGAGKTTLLNTLAKRANVGIVTGDMSINGKPVDSSFERRTGYVQQQDIHIAEMTVRESLVFSARLRRPQSIPDAEKVADAETVMKLLDMEEYGDALVGGLGAGLNVEQRKKLSIGVELVAKPDLLLFLDEPTSGLDSQSSWAIVQLLRRIAKAGQCILCTIHQPSATLFEQFDRLLLLKKGGQTVYFGDIGENSSIVLDYFERNGARHCEQRENPAEYVLEAIGAGATASVKEDWHEIWQRSEECRATDQKVAEWIQELSTQDFDVGEVGEKSSKYATNYFYQFKYVWMRTNLTLYRDLRYIFSKFMLQIMSGLYIGWTFYNPGKSYVGLQDTLFAAFVSVIVSAPSMKQIQARALASRSLFEVRESKSNMFHWSLLLLTQYLAEIPYHILFSTMFFCAFYFPLRVWFEASRSAVFFLNYCIMFQLFYVGLGLMILYMAPNLPSANVIMGLILSMMIQFCGVTQPMSLMPGFWTFMWKASPYTYFIQNLVAIVLHKKPVVCKKKELNYFDPPQGKTCGEYMHTFLKRSQGYIANPDATSNCAYCQVSVGDEYLSQRGVSYGNIWRNFGFYWAYIIFNLFAMVGVYYIFSVRGLRSFNPFLFIKRIIKRQ

SEQ ID NO: 175 - DNA, 4557 bp, Kluyveromyces lactis
atgtcttctgaatcgacaacaggtcgtaagactaatgaggatggaagaaattccatccattctactgattcctatgctcaatcagtaaattccttccattacgaagaggataacgaatctcaaaatgctgcttctcaattatcccgtcaaatcactaccatcttgtctcaagaaaatggtgctgatagaatcgaatccttggcaagagtcatctctacgaagaccaagaagcagatggaatcgtttgaagttgatcaattggatttcaatttgaaagccttattggattacttacgtaactctcaaatcagccagggtattgaatcaggtgattccggtgttgccttcaacgatttgaccgctgttggtgtcgatgcttctgctgccttcggtccctccgtggaagaattaatacgttcttggggtcatcttccagtacatctttggaagaaaatgactggtaagaaagatgatgtcccattgcgtaacattatccaacactgtgtcggtgtcgtcgaatccggtgaaatgttattcgttgtcggtagaccaggtgctggttgttccactttactaaaatgtgtttctggtgaaacaagtgaattagtcgaagtcactggtgacttctcttacgatggtctttctcaggctgaaatgatggaaaaattcaaagggtacgtcatttactgtcctgaattggatttccatttcccaaagattaccgtcaaggaaactatcgatttcgctttaaaatgtaagactccaagagtccgtatcgaccatctttcaagaaaccaatacgtcgacaacatgagagatctttggtgtactgtctttggtttaagacacacttatgctaccaacgtcggtaacgatgtggtcagaggtgtctctggtggtgaacgtaagcgtgtttctcttgtggaagctctagctatgagtgcttccatttactcttgggataacgctactcgtggtcttgatgcctctaccgctttagaatttgctcaagccattcgtactgctaccaatttaatgaataactctgctattgttgccatttaccaagcaggtgaaaacatttacgaattattcgataagactaccgtcttatacaacgggaagcaagtttatttcggtccagctaccgaagctgtcggatacttcgaaagaatgggttacattaagccaaacagaatgacatctgcagaattcttaacttcggtgaccgtagatttcgccaacagaaccctagctattaaggatggttacgaagaaaaaatgccaaagtcatctactgaaatggaagcctactggcacaactctgaagaataccaaagagccgttgagtactatcaccaatattgtgctgctcatcctgaagaagagacaagacaaagattggaattggccaagcatcaaagattgcaaaagggtcaaagagccaaatctcaatacgtcgttactttctggtctcaagtgtggtattgtatgatgcgtgggttccaaagaaccaagggtgatttcacatatactaaagtttatttgtcctctttcttaactaaaggtttgattgtcggttctatgttccacaaaatcgatccaaagagtcaatctactaccgatggtgcttactctcgtggtggtttgattttctacgtcttattgtttgctgctgtgacctctttggctgaaatctcaaattctttccacaacagagcaattgtcgtgaaacataagacttattctatgtatcacacctccgctgaatccttacaagaaattttcactgaaatgccaactaaattcgttgctgtgttgactctttcacttgtttcctactggattcctgtcttgaaatatgatgctggttctttcttccaatttttgttatatttgttcaccactcaacaatgtacttcgtttatctttaaattggtcgccacattgaccaaagatggtggtactgctcacgctattggtggtctatgggttttaatgttaactgtctacactggtttcgtgttaccaatcggtgaaatgcatcactggatcagatggttccattacctaaatcctttaacctacgcttatgaatccttgatgtcgactgaattccatggtagacaaatgctttgttcccaattaattccttcaggaccaggttatgaaggagtttccatctccaaccaaatctgtaatgctgctggtgcaattgcaggtaacttatatgtttctggtgatacctatgttttgaagaagtatcatttctcatacaatcacgcttggagagattggggtattaacatcgtttggacttttggttatattgtcatgaacgttgttatgtctgaatttttgaaaccattagaaggtggtggtgacttgctattgtacaagagaggtcacatgccagaattgggttcagaaagtgttgataccaaggttgcttcaagagaagagatgatggcatctttgaacggtcctgacgttgatttggcaaagattattgaatccaaggatgtctttacctggaaccacttgaattatacaattccttatgatggcgctactagacaactattgagtgacgtgtttggttacgttaagcctggtaagatgactgcattaatgggtgaatctggtgctggtaagaccacgttgcttaatgtgttggcccaaagaatcagtgtcggtgttattactggtgatatgttggtgaacgccaaggatctacctttatccttcaacagatcctgtggttacgttgctcaatctgataaccatatgggtgaattgtccgtgagagaatcattgagattcgctgctgaattgagacaaccaaaatctgttccactacaagaaaagtatgattacgtcgaaaagatcatctctttgttgggtatggaaaagtatgctgaagctatcattggtaagaccggtagaggtttgaatgtcgaacaaagaaagaagttatctattggtgttgaattggtcgctaaaccatcattgctattgtttttggatgaaccaacctccggtctagattctcaatctgcttggtctattgttcaattcatgagagctttggctgattctggtcaatctattttgtgtactatccatcaaccttctgctaccttattcgaacaattcgatagattattattattgaagaagggtggtaagatggtgtactttggtgacatcggtgaaaattccggtactttgctaaactacttcgagcgtcaatctggtgttaagtgtggtatctctgaaaatcctgctgaatatatgttaaactgtatcggtgctggtgcaactgcctctgcctcagaggactggcatgatctatggctaaaatctcctgagtgtgcagctgccagagaagaagtcgaagaattgcatagaaagttggcttctagacctgttactgatgacaaggaattatctggtaagtatgctgctaactacttgactcaattgaaatgtgttttcggaagaacttggcttcaattctggagatctccagtctacattagagccaaattcttggaatgtgtcctgtgtgctttgttcgttggtttgtcttacgttggtgttaaccactcgattgccggtgccaatcaatcgtttgcatctattttcatgatgttattgattgccttagctatggttaaccaattgcatgtgtttgccttggattctagagaattgtacgaagtcagagaagctgcttcgaacactttccattggtctgcattgttgttatgtcactgtaccgtcgaaatcatctggtccaccgcctgtgaatttatctgttggatttgttactattggccagcacaatacactggtcgtgcttcccatgctggttacttcttcttgatttacgttatcatgttccctgcatactttatctcttacggttgttgggtgttctatatgtctccagatgtgccatctgcttctatgatcaactccaacttgttcgctgccatgttgttattctgtggtatcttgcaaccaagagaaaagatgcctggtttttggaagagattcatgtacaacgtgtctccattcacttatgttgtccaatcgttagtcgcaccaattgttcaaggtaaaaaggtcgtctgtggcaggaatgaattcgccgttatggatccaccagaaggtcaaacatgtggtgaatacttgtcaacttacatcgaagataacactggttacttgaccaatccaaatgacacacaaagctgtcagtactgtccatacagctaccaacaagaagttgttgcaagatttaatgtcaaatgggtctataggtggagaaatttcggtttcctatgggcatatattatcttcaacttcttcgcaatgttgttctgctactgggttatgagagtgaagaactactccgttactagtattttcaagatcttcaagatcggtacttggaagaatgctattaaaccaaaggacagacacgaaaaggacacaactattttccaagaaaaaccaggagatgctgaaaatgtcaatagaaccaagaattaa

SEQ ID NO: 176 - protein, 1518 aa, Kluyveromyces lactis
MSSESTTGRKTNEDGRNSIHSTDSYAQSVNSFHYEEDNESQNAASQLSRQITTILSQENGADRIESLARVISTKTKKQMESFEVDQLDFNLKALLDYLRNSQISQGIESGDSGVAFNDLTAVGVDASAAFGPSVEELIRSWGHLPVHLWKKMTGKKDDVPLRNIIQHCVGVVESGEMLFVVGRPGAGCSTLLKCVSGETSELVEVTGDFSYDGLSQAEMMEKFKGYVIYCPELDFHFPKITVKETIDFALKCKTPRVRIDHLSRNQYVDNMRDLWCTVFGLRHTYATNVGNDVVRGVSGGERKRVSLVEALAMSASIYSWDNATRGLDASTALEFAQAIRTATNLMNNSAIVAIYQAGENIYELFDKTTVLYNGKQVYFGPATEAVGYFERMGYIKPNRMTSAEFLTSVTVDFANRTLAIKDGYEEKMPKSSTEMEAYWHNSEEYQRAVEYYHQYCAAHPEEETRQRLELAKHQRLQKGQRAKSQYVVTFWSQVWYCMMRGFQRTKGDFTYTKVYLSSFLTKGLIVGSMFHKIDPKSQSTTDGAYSRGGLIFYVLLFAAVTSLAEISNSFHNRAIVVKHKTYSMYHTSAESLQEIFTEMPTKFVAVLTLSLVSYWIPVLKYDAGSFFQFLLYLFTTQQCTSFIFKLVATLTKDGGTAHAIGGLWVLMLTVYTGFVLPIGEMHHWIRWFHYLNPLTYAYESLMSTEFHGRQMLCSQLIPSGPGYEGVSISNQICNAAGAIAGNLYVSGDTYVLKKYHFSYNHAWRDWGINIVWTFGYIVMNVVMSEFLKPLEGGGDLLLYKRGHMPELGSESVDTKVASREEMMASLNGPDVDLAKIIESKDVFTWNHLNYTIPYDGATRQLLSDVFGYVKPGKMTALMGESGAGKTTLLNVLAQRISVGVITGDMLVNAKDLPLSFNRSCGYVAQSDNHMGELSVRESLRFAAELRQPKSVPLQEKYDYVEKIISLLGMEKYAEAIIGKTGRGLNVEQRKKLSIGVELVAKPSLLLFLDEPTSGLDSQSAWSIVQFMRALADSGQSILCTIHQPSATLFEQFDRLLLLKKGGKMVYFGDIGENSGTLLNYFERQSGVKCGISENPAEYMLNCIGAGATASASEDWHDLWLKSPECAAAREEVEELHRKLASRPVTDDKELSGKYAANYLTQLKCVFGRTWLQFWRSPVYIRAKFLECVLCALFVGLSYVGVNHSIAGANQSFASIFMMLLIALAMVNQLHVFALDSRELYEVREAASNTFHWSALLLCHCTVEIIWSTACEFICWICYYWPAQYTGRASHAGYFFLIYVIMFPAYFISYGCWVFYMSPDVPSASMINSNLFAAMLLFCGILQPREKMPGFWKRFMYNVSPFTYVVQSLVAPIVQGKKVVCGRNEFAVMDPPEGQTCGEYLSTYIEDNTGYLTNPNDTQSCQYCPYSYQQEVVARFNVKWVYRWRNFGFLWAYIIFNFFAMLFCYWVMRVKNYSVTSIFKIFKIGTWKNAIKPKDRHEKDTTIFQEKPGDAENVNRTKN

SEQ ID NO: 177 - DNA, 4698 bp, Saccharomyces castelli
atgactaaggttgcgaatgtcttctgcggctgtttctgtgccccgcggcgtgagcgtattcccgtggacataagaaatttgagggaggaggtaataacgaaacatattaagctaccaagttatataactttaaaatacacccattttctgacacagacattccaaaaactacaacttaacgagagaatactaatggacagaatggactctagtattcaaagtgcatcaacctccgggaaaatagtaccggagtcaactcctccagaagaagctgtctctgacgcttgctccacagcttcctcagttggcgaaatagctgtaggaacaacaacagaacccttaaaaaacagagcaaaattgaactacgcatcctcaggggagttaaccgctgatatggttagcagagtggaatcgttcgcggatgccctgtcacatcatactacgaggtcagggtcgttcgatatgaagaacgtttcagatgatggtttcgatgctcaggaaatatttgaaaggttcgttagagatgcagatgaacagggaattcatattcgtaaagctggggtcactatggaagacgttactgctgaaggtgtggatgcctccgctttggaaggtgccacatttgggaacgtattatgtttgccatatacaatttacaagggaataagggcgagaaggaacaggaaatggagaaagattatacagaatagttatgcccttgctaaaccgggtgaaatgattcttgttctagggagaccaggtgcaggatgctcttcattcttgaaagtcattgcaggtgaaattgatcaatttcctggcggtgtgaaaggggaaatcacttatgatggtattcctcaaaaggaaatgatgaaacattataaatcagatgttatatataatggagaattggatgtacatttcccacatttaactgtgcaacaaactttggatttcgcgttggcttgtaagacaccagctaagcgggttaacaatatttccagagatgaatatataaaatcgtccagagagttatatgccactatctttggtttaagacacacatataacacaaaagttgggaatgattttgtcagaggtgtgtcaggtggtgaacgtaaacgtgtctccattgctgaagctcttgctgccaatggttccatttactgttgggacaatgccactagaggtttagacgcatccactgcccttgagtacgctaaggcaatccgtatcatgactaaccttttgggatccaccgcttttgttactatttatcaggccagtgaaaacatatatgaaacttttgacaaagtaaccgtgctagcgaagggccgtcaaatctattttggtaagatcgaagatgcaaaggcttattttgaaaatatgggatatatatgtcctcctagacaagttatggccgaatttctaacagcaattacggatcccaatgggtaccataagattaaatctggctttgaaaacaaagtgcctgtcactcccgtagaactggaagagtattggcataattcaccagagtttgcaaaattgaaagaagatattacaacatataagacaaacgtagatactgagaatacaagagaaatgtacaaaaaatctatgaaagaagaaaaatcaaaacattcaagtaaaaaatcattctataccgtttcattttgggaacaagtacggctttgtaccattaggggaactcaaaggatttatggtaataagacatacacagttattaatatatgttctgccattattcaagcatttatcactggttcattgttctacaatatcccctctgataccaatggtgccttttcgagagggggtgtgttgtatttcactttattatactactctttaatgggtttagcaaatatgtcatttgatcatagacctatattacaaaagcataaaggttattcattataccatccaggggctgaagctattgccagcgctcttgcagctttcccttttagaatgatcggactaacctgcttctttattatcatctttttcttaactaatttacacagagccccaggtcctttctttatgatgtaccttttcctaaccatgtgttcggaagctattaatggtcttttcgaaatgatcgctgctgggtgtgatacactagctcaagcaaactccattgctggtattttgatgttgtgcatttcattatactccagttatatgatacaactaccctcaatgcatccatggtttaaatggatctcatatattattccaatcaggtatgccttcgaatcgatgcttaatgccgaatttcatggaagacatatggattgtggtggtactcttgtgccaacaggtccaggatacgaaaacgtgtcaagtgagaatagagtttgtgcgtttgtcggttccgaacctggtcaatcctgggttcttggtgatgattatttaaagaaacaatttacttacgagtacaagcatcaatggaggaattttggtattatgtggtgtttcctaattggttatatgtttattaaagcattcatcaccgaacataagagaccagttaaaggtggtggtgacgctttattattcaagaagggtagtataaggtataacgatgttaatgacttagaatcatctgataactctaatgatactgaaatcaaggacaaatttactagtactacaatttccactgatgaagaaggagcattcgaggaattggaatccaagggtgtctttttatggaaagaagtctgttatacaattccatacgaacgtggtaagcgtatgcttttagaccatgtttctggatattgtgtacctggtacattaacagcattgatgggtgaatctggtgcagggaaaacaactttactaaataccttagccaagaggaacgaaatcggtgtggtgaccggtgatatgcttgtgaatggacgtcccgttgatgctagttttgaaagacgtactggctatgttcaacaacaagatatccatattgcagagttaactgtcagagaatctttacaattctcagctcgcatgcgtcgctcagagcacgtgtcagatgaagaaaagctagcttatgtggagaaaatcatccgtgttctggaaatggaggaatttgctgatgcattggttggtgctattggatgtggtttgaatgttgaacaaagaaagaaattgtctattggtgtggagttggttgctaaacctgatttattattatttttggatgaacccacttctggtttggactctcaatcttcctgggccatcgttcaattgttgaggaaattagctcaagctggtcaatctatcttgtgtactatccatcaaccttctgctacgttatttgaacagttcgatagattattattattaaagaagggtggtcaaactgtttactttggtgacattggtgaaaattctgagatattattgaaatacttcgaaaaaagcggtgcaaggaagtgtgatcgtaaggaaaatccagcagagtatattttagaagctattggagccggtgcaactgcctcagtcaaggaagattggcatcaaatttggctggactctgcagaacaccatgctgccgaagaaaaagttagccaaatgatatctgagttaagtcaaaaaagagatgaatctgatattggagacaaagccactaaatacgccacttcttatagataccaatttgggtttgtcctaagaagaacaggtataacattttggagaaatttgaattatatcatgtcaaaaatgatgcttatgaccgttgcaggtttatttattgggtttacattttttggtgttggaagtagttttactggtctccaaaatgccatgttcacagcatttatttcaatcatcgtttccgcaccagctatgaatcaaatgcaggctcgagctattgctgctagagacttatatgaggtcagagaatccaagtctaatatgttccattggtctttattgttaattacccaatatttgaatgaactgccttatcatttattcttctcaaccattttctttgtttcatcgtatttccccttaagaatattcttcgaagcctctagatccggtgtttactttttgaattattgtattatgtttcaattgtattatgttgggctagggttattgattctttatatgtccccaaatttaccatcagcaaatgttttattaggtttggcaatgtcgttcttaattgcattttgtggggtgacccaacctgcatccctaatgccaggcttttggacatttatgtggaagacttccccatatacttattttgttcagaatttggtaggtattatgcttcatgagaaacctgttatatgtacgaagaaggaattaaacttctttgacccacctgctggacagacatgcggtcagtacatggctcccttcctgtcaagggctactggttatattgcagatcctgatgctacttctaattgtgcttactgcttatactctgttggtgatgagtatttgacaagaattagcgcctcctacagttacttatggagaaactttggtatctattgggcttacattatctttaacttatttgccatggtcactctctactacattttccacgttaagaagttatctatatttaaattaaaaccagtcaagaggctaatcaggaaaatagggggcactgcgcaagagactatgtcgtaa

SEQ ID NO: 178 - protein, 1565 aa, Saccharomyces castelli
MTKVANVFCGCFCAPRRERIPVDIRNLREEVITKHIKLPSYITLKYTHFLTQTFQKLQLNERILMDRMDSSIQSASTSGKIVPESTPPEEAVSDACSTASSVGEIAVGTTTEPLKNRAKLNYASSGELTADMVSRVESFADALSHHTTRSGSFDMKNVSDDGFDAQEIFERFVRDADEQGIHIRKAGVTMEDVTAEGVDASALEGATFGNVLCLPYTIYKGIRARRNRKWRKIIQNSYALAKPGEMILVLGRPGAGCSSFLKVIAGEIDQFPGGVKGEITYDGIPQKEMMKHYKSDVIYNGELDVHFPHLTVQQTLDFALACKTPAKRVNNISRDEYIKSSRELYATIFGLRHTYNTKVGNDFVRGVSGGERKRVSIAEALAANGSIYCWDNATRGLDASTALEYAKAIRIMTNLLGSTAFVTIYQASENIYETFDKVTVLAKGRQIYFGKIEDAKAYFENMGYICPPRQVMAEFLTAITDPNGYHKIKSGFENKVPVTPVELEEYWHNSPEFAKLKEDITTYKTNVDTENTREMYKKSMKEEKSKHSSKKSFYTVSFWEQVRLCTIRGTQRIYGNKTYTVINICSAIIQAFITGSLFYNIPSDTNGAFSRGGVLYFTLLYYSLMGLANMSFDHRPILQKHKGYSLYHPGAEAIASALAAFPFRMIGLTCFFIIIFFLTNLHRAPGPFFMMYLFLTMCSEAINGLFEMIAAGCDTLAQANSIAGILMLCISLYSSYMIQLPSMHPWFKWISYIIPIRYAFESMLNAEFHGRHMDCGGTLVPTGPGYENVSSENRVCAFVGSEPGQSWVLGDDYLKKQFTYEYKHQWRNFGIMWCFLIGYMFIKAFITEHKRPVKGGGDALLFKKGSIRYNDVNDLESSDNSNDTEIKDKFTSTTISTDEEGAFEELESKGVFLWKEVCYTIPYERGKRMLLDHVSGYCVPGTLTALMGESGAGKTTLLNTLAKRNEIGVVTGDMLVNGRPVDASFERRTGYVQQQDIHIAELTVRESLQFSARMRRSEHVSDEEKLAYVEKIIRVLEMEEFADALVGAIGCGLNVEQRKKLSIGVELVAKPDLLLFLDEPTSGLDSQSSWAIVQLLRKLAQAGQSILCTIHQPSATLFEQFDRLLLLKKGGQTVYFGDIGENSEILLKYFEKSGARKCDRKENPAEYILEAIGAGATASVKEDWHQIWLDSAEHHAAEEKVSQMISELSQKRDESDIGDKATKYATSYRYQFGFVLRRTGITFWRNLNYIMSKMMLMTVAGLFIGFTFFGVGSSFTGLQNAMFTAFISIIVSAPAMNQMQARAIAARDLYEVRESKSNMFHWSLLLITQYLNELPYHLFFSTIFFVSSYFPLRIFFEASRSGVYFLNYCIMFQLYYVGLGLLILYMSPNLPSANVLLGLAMSFLIAFCGVTQPASLMPGFWTFMWKTSPYTYFVQNLVGIMLHEKPVICTKKELNFFDPPAGQTCGQYMAPFLSRATGYIADPDATSNCAYCLYSVGDEYLTRISASYSYLWRNFGIYWAYIIFNLFAMVTLYYIFHVKKLSIFKLKPVKRLIRKIGGTAQETMS

SEQ ID NO: 179 - DNA, 2028 bp, Saccharomyces castelli
  misc_feature (34)..(34): n is a, c, g, or t
  misc_feature (83)..(83): n is a, c, g, or t
aaaagaaagaaaagagttcctagtgaaaccaatnctttgttgaagagggatgcatttgagaaactggaatcaaaaggtgtttncatctggagagatgtgtgctacactattccatatgatgccggtcaaagaatgttattggatcatgtttctggttactgtatccccggtacgatgaccgctgtaatgggtgaatctggtgctggtaagactacattattgaacactttggctcaaagaaatgttggtattattactggtgatatgttaattaatggtcgtccgatcgatgctagttttgaaagacgtaccggttatgttcaacaacaagatgtccatattgcggaacttacagtgagagaatctttacaattctcagctcgtatgcgtcgtgctcaagctattcctgatgaagaaaaaatggcatatgttgaaaagattattcatgtgctagatatgcaagaatatgccgaagctctagttggtgaaattggtcgtggtttgaatgttgaacagagaaagaagttgtccattggtgtggagttggttgctaaacctgatttactattatttttggatgaacctacttctggtttggactctcaatcttcctgggccattattcaattgttaagaaaattggctcaagctggtcaatctatcttgtgtactatccatcaaccttctgctacgttatttgaacaattcgatagattattattattaaagaagggtggtcaaactgtttactttggtgatgtcggtaagaattcaaggactttgttggactattttgaaggtaacggtgccagaaaatgtgatcgtaaggaaaaccctgcagagtatattttagaagctattggtgctggtgctactgcatctgtcaaggaagattggcatgaaatttggaaaaactctaaggaatatatgagaactgcagaaaaggttgatgaactaatcaaagagttatcgtcaaagcctgatgatgctaatggtgatagtaattcaggaaaatatgccacgtcctatggttaccaattttcctatgttttaagaagaacaggtattactttttggagaaacttaaactatatcatgtccaaaatgatgcttatgactgtcggtgggttatatattgggttcaccttttatgatgtcggtaaatcgtatactggtttacaaaatgcgatgtttgcggcttttatttcgattgttgtttctgcaccagccatgaatcaaattcaagctcgtgcaattgctgctagagatttatatgaggttagagaatccaagtctaatatgttccattggtccttattattagtcacccaatatttgaatgagctgccttatcatttgttcttctcaaccattttctttgtctcatcgtatttcccattaagaattttctacgaagctccaagatccggtgtttactttttgaattattgtattatgtttcaattgtattatgttggctttgggttaatggttctttatgcatctccaaatcttccatctgctaatgtgatcctaggtttatgtttatcgttcctaatctcattctgtggtgttactcaacctaaatctttaatgcctggtttctggacatttatgtggaaggcatctccttacacttactttgttcaaaacatggtcggtattatgcttcataagaaacctgttgtatgttccaaaaaggaattaaactatttcaatccgccaagtggtcaaacttgtggccaatacatggaaaaattcttatcttctgctagtgggtatatcaagaatcctgacgatacatcgaactgtgcatactgtatatattccgttggtgatgaatatttgacccacatcagttcctcctactcttatttgtggagaaacttcggtctctactgggcctatatcattttcaatattttcggtatgatttctctgtattacatcttccatgtgagacagacttcattgttaaacctctcctttgttaagaagggcctaggtaaggtgaaggggaagaaatag

SEQ ID NO: 180 - protein, 675 aa, Saccharomyces castelli
  misc_feature (12)..(12): Xaa can be any naturally occurring amino acid
  misc_feature (28)..(28): Xaa can be any naturally occurring amino acid
KRKKRVPSETNXLLKRDAFEKLESKGVXIWRDVCYTIPYDAGQRMLLDHVSGYCIPGTMTAVMGESGAGKTTLLNTLAQRNVGIITGDMLINGRPIDASFERRTGYVQQQDVHIAELTVRESLQFSARMRRAQAIPDEEKMAYVEKIIHVLDMQEYAEALVGEIGRGLNVEQRKKLSIGVELVAKPDLLLFLDEPTSGLDSQSSWAIIQLLRKLAQAGQSILCTIHQPSATLFEQFDRLLLLKKGGQTVYFGDVGKNSRTLLDYFEGNGARKCDRKENPAEYILEAIGAGATASVKEDWHEIWKNSKEYMRTAEKVDELIKELSSKPDDANGDSNSGKYATSYGYQFSYVLRRTGITFWRNLNYIMSKMMLMTVGGLYIGFTFYDVGKSYTGLQNAMFAAFISIVVSAPAMNQIQARAIAARDLYEVRESKSNMFHWSLLLVTQYLNELPYHLFFSTIFFVSSYFPLRIFYEAPRSGVYFLNYCIMFQLYYVGFGLMVLYASPNLPSANVILGLCLSFLISFCGVTQPKSLMPGFWTFMWKASPYTYFVQNMVGIMLHKKPVVCSKKELNYFNPPSGQTCGQYMEKFLSSASGYIKNPDDTSNCAYCIYSVGDEYLTHISSSYSYLWRNFGLYWAYIIFNIFGMISLYYIFHVRQTSLLNLSFVKKGLGKVKGKK

SEQ ID NO: 181 - DNA, 4242 bp, Saccharomyces bayanus
atgtctctttccaaatatttcagtccgattcctgacgcttccgtcacatttgatggcaccaccgttcagctggaagaatctctcggagctgtccggaacgatgaagaatccttgtctgacctcgagaatgcaggccgtgtggaaatcagcgatatcaccttccgtgctaacgaaggtgaggtcgtcttggtactagggaacccgacatcagcgctcttcaaagggctattccatggtcacaagaatctgaggtactctccagaggggtctatcagattcaagaacaatgagtataagcaatatgccgccaagtgtcctcaccaaatcatttataataacgaacaggatatccacttcccttacctaacggtcgaacagaccatcgattttgcattgagttgcaagttccgtgtacccaagcatgaacgcattgaaatgagagatgagttactgaaagaattcggcctatcacatgtaaagaagacgtatgtcgggaacgactacgttcgtggtgtttctggtggtgagagaaaacgtatctccattatcgaaaccttcattgctaatgggtctgtgtatctgtgggataactcgacaaagggcctggattctgcgactgccttggaatttctctccattacccaaaaaatggcaagggccaccagatcagttaattttgtcaagatctctcaggccagtgacaaaatcgtcagcaaatttgacaagattcttatgctgagcgattcttaccaggtgttttacggcaccatggacgaatgcttaagttatttccatgacactttgcagataaaaaaaaaccctaacgattgtatcattgaatatctgacgtcaatcctgaatttcaaatttaaggaaatatccaattccatcgttggtctcgacacaccatccgtcgtctctgaacccaaccaagcttcgaacatcaataacgaagcagatttacacacactatgggtacaatctccttactacaaacactggaaggcaatcacctcaaagacaatacaagaatgcaccggaccggacatcaatccagacgatgtttctcccgtgttcagtatcccactaaaattacaactgaaaacctgtacgataagagctttccaaagaattattggtgacagaaactacttgatctctcagtttgtttctgtcgttgtacaatctttagtcattgggtctcttttttatgacatccccctaacaaccatcgggtccttctctagaggatctctgacttttttctccattctgttctttaccttcctttccctggctgatatgcctgcttctttccaaaggcaacctgtggttcgcaaacatgtccagcttcatttctattttaattgggtcgaaacgttggcaacaaacgttttcgactgtttttccaaatttttactcgttgtcgtgttcactatcattctttactttttagctcatttacaatacaatgctgctaggtttttcatctttttgcttttcctttccatctataatttttgtatggtttcattatttgccctgacggctttgatcgctccaactttatcaatggcaaatcttttagctggtatcttactactcgctattgctatgtatgcgtcttatgttatttacatgaaagatatgcacccatggtttatctggatcgcttatttgaatcctgctatgtttgccatggaagctatcttgagtaacgaattgttcaaccttaagctagattgtcaggaaagtattattcccagaggcgagtcctataacaatatttcattcagccataaagcttgtgcttggcaaggtgcaacgctaggtaatgattatgtcagaggtcgcgattatttaaagagtgggctaaaatacagctatagtcatgtatggagaaatttcggtatcattattgggtttctgtgtttcttcttattctgttctttagcagcctctgagtacatcactcctttgttcaccagagaaaatatgctgcgttggaataactacttcaaaagacattgccccttctcaagtaacaaaaagagacaggaaaaggctattaccattaccgatagccctggtatatgcagcaccaagcccccggcaaccaattcatccacttcatcttcatctgtcccatcattctcccgtcgctacgatgctgattataatatcaagtatcccgttgaagctgttaacaaccacactaaggaatccatagctgtagaaactcaaaagcacgtcatttcctggaagagtatcaattataccattggcgataaaaaactgattaacgatgcttctggttatataagctccggattaaccgcattgatgggtgaatccggtgctggtaagacaactttgctgaacattttgtctcaaagaaccgaaggtggtgtggtaaccggtgaattattaatcgacggtcagccattaactaacattgatgcttttagacgaagtattgggttcgtccaacaacaagatgttcatttagagttgttaactgttaaagagtctttagaaatttcctgtgttttaagaggtgacagcgatagggagtatttaggaactgttaccaatctattgagattaccttcggaaaaacttgttgccgatttgtcccccactgaaagaaagctattgtccattggtgttgaattagttaccaagccttctctgctattatttttggatgaacctacttctggtttagatgctgaagcagcgttaaccattgtacagtttttgaaaaagctttcgatgcagggccaggctattttatgtactatccaccaacccagtaagagtgttatcagttattttgataacgtttacctattaaaaagaggtggcgaatgtgtctactttggttcattgactgatgcctgtgactattttgtggctcacgacaagagcttagtttttgacagtgaagcggataatccggctgatttcgtcatcgatgttgttggtagtggaaatactaatactgaaactaatgctgaggaaaaatcaacctctggtagatttgaccagcaaacatctcatcgtagacaatcagattactcaatcaactgggcaaatatttggcaatcttctcctgaaaaggtgaagattgctgataatttgcttatattggaaaaagaagctcgaaattctggtgttgattttacgacttctgtatggagtgcaccttcatatatggaacaagtaaaattgattaccagaagacagtatatttgtaccaagagggacatgacttatgtctttgccaaatttgctctaaatgctggtgctggtttattcatcgggttttccttttggaggacaaagcacaatatcagtggtttgcaagacgctattttcttgtgttttatgatgctttgtgtttcttcccccttaattaatcaagttcaggataaagcattgcaatcaaaggaagtctatatagccagagaggcgagatctaatacctaccattggacagttcttttgatcgcccagaccatcgttgaattaccactagccatttctagttccacattgtttttcctatgttgttacttctgttgcggttttgaatcttctgctcgtgtagctggtgtcttttatttgaactatattttatttgccatctattatttatcgtttggattatggttattatactcagctcctgatttacagactgcagccgtatttgttgcattcctgtatagttttacagcttcgttctgtggtgtgatgcagccttacgcgttgttcccacgattttggacattcatgtacagagtttcaccatacacatacttcatcgagacttttgtaactttgcttcttcatgatagaaaaattacttgttcaacgggtgaaatggtcccaagtcaacctgtaatgggccaaaattgtggtcaattcatgaaaccctttattgaagaatatggtgggaaattactcaatgataacacatttactgtctgcgcctattgtatgtacactgttggcgacgatttcttggatcaagaaaatatgagctatcaccacagatggagaaattttggtttggagtgggttttcgtctgcttcaactttgtggccatgtttgtcggcttctacctaacctacattaagaagatatggccttcagtgatcagcggcgtcaagaagtgtattccaccgatgggaatgtccaaaaaaactaaaaaaaacaaaaaagtcaatgcatag

SEQ ID NO: 182 - protein, 1413 aa, Saccharomyces bayanus
MSLSKYFSPIPDASVTFDGTTVQLEESLGAVRNDEESLSDLENAGRVEISDITFRANEGEVVLVLGNPTSALFKGLFHGHKNLRYSPEGSIRFKNNEYKQYAAKCPHQIIYNNEQDIHFPYLTVEQTIDFALSCKFRVPKHERIEMRDELLKEFGLSHVKKTYVGNDYVRGVSGGERKRISIIETFIANGSVYLWDNSTKGLDSATALEFLSITQKMARATRSVNFVKISQASDKIVSKFDKILMLSDSYQVFYGTMDECLSYFHDTLQIKKNPNDCIIEYLTSILNFKFKEISNSIVGLDTPSVVSEPNQASNINNEADLHTLWVQSPYYKHWKAITSKTIQECTGPDINPDDVSPVFSIPLKLQLKTCTIRAFQRIIGDRNYLISQFVSVVVQSLVIGSLFYDIPLTTIGSFSRGSLTFFSILFFTFLSLADMPASFQRQPVVRKHVQLHFYFNWVETLATNVFDCFSKFLLVVVFTIILYFLAHLQYNAARFFIFLLFLSIYNFCMVSLFALTALIAPTLSMANLLAGILLLAIAMYASYVIYMKDMHPWFIWIAYLNPAMFAMEAILSNELFNLKLDCQESIIPRGESYNNISFSHKACAWQGATLGNDYVRGRDYLKSGLKYSYSHVWRNFGIIIGFLCFFLFCSLAASEYITPLFTRENMLRWNNYFKRHCPFSSNKKRQEKAITITDSPGICSTKPPATNSSTSSSSVPSFSRRYDADYNIKYPVEAVNNHTKESIAVETQKHVISWKSINYTIGDKKLINDASGYISSGLTALMGESGAGKTTLLNILSQRTEGGVVTGELLIDGQPLTNIDAFRRSIGFVQQQDVHLELLTVKESLEISCVLRGDSDREYLGTVTNLLRLPSEKLVADLSPTERKLLSIGVELVTKPSLLLFLDEPTSGLDAEAALTIVQFLKKLSMQGQAILCTIHQPSKSVISYFDNVYLLKRGGECVYFGSLTDACDYFVAHDKSLVFDSEADNPADFVIDVVGSGNTNTETNAEEKSTSGRFDQQTSHRRQSDYSINWANIWQSSPEKVKIADNLLILEKEARNSGVDFTTSVWSAPSYMEQVKLITRRQYICTKRDMTYVFAKFALNAGAGLFIGFSFWRTKHNISGLQDAIFLCFMMLCVSSPLINQVQDKALQSKEVYIAREARSNTYHWTVLLIAQTIVELPLAISSSTLFFLCCYFCCGFESSARVAGVFYLNYILFAIYYLSFGLWLLYSAPDLQTAAVFVAFLYSFTASFCGVMQPYALFPRFWTFMYRVSPYTYFIETFVTLLLHDRKITCSTGEMVPSQPVMGQNCGQFMKPFIEEYGGKLLNDNTFTVCAYCMYTVGDDFLDQENMSYHHRWRNFGLEWVFVCFNFVAMFVGFYLTYIKKIWPSVISGVKKCIPPMGMSKKTKKNKKVNA

SEQ ID NO: 183 - DNA, 4497 bp, Zygosaccharomyces rouxii
atggcagaaggttctccatccgatagtttcgtaaccgccgatggccaaatggcctatggaggcttcgatgaggttaccaagaataatgtgaggaatgctgttgagagttttgttaaaagtaatttagataggtccgatctgatgaaattggatagttcacaagaagttgctggtattaatccaattggattgaaagaaggtgatcctgattacgacacaagactagatccaaattccgacagcttttctagcaaggaatggattaaaaacctggcaaagataaaggaggttgatcctgattatttcaaaccacataaacttggatgttgttggaagaatttgtcggttgttggtgattcctcagatatttcttatcaatcaacgtttgggaatgtgccttgtaaaattatcggttgggtttctagatatgtgagaccttcgagaaaatctcacaagtttcaaattttaaaatcaatggacggtattgttaatcctggtgaattgttagttgtattgggtagacctggttcggggtgtacaactttgcttaaatccgtttcgtctaatgcacacggagttcatgttagtgaagattcaactatatcttataacggtattgcaccgagtgagataaagaaacattttcgcggtgaagtggtttataatgcagaaacggatatacacattcctaatatttctgtttatcaaaccctgcttacagttgcgaggttaaagaccccacagaatagaattaaaggtgtggatagagaatcatgggctaatcacattgctgaggttgccatggcgatgtatggattatcccatactagagatactaaagtagggaatgaagtcgtgagaggtgtttcaggaggtgagaggaagcgtgtttctattgcagaagttaccatctgcggatctaagttccaatgttgggacaatgccacaagaggtttggattctgctactgcattagaatttgtcaaggcacttcgagcacaggcagatattgagaatagtgcggcatgcgttgccatttaccaatgttctaaggatgcatatgatttgttcgataaagtatgcgttatgcatggtgggtaccaaatttatttcggtgccgccaaagatgcaaaacgttacttcgaaaaaatgggatattattgtcccagtagacaaaccactcctgactttttaacatcaattacaagctgtgcggaaagaattgttaataaagaatttattgaaagagatgtatttgttcctcaaacggctgaagaaatgtcagattattggcgtagttctcaagagtttaaagagttacaacaagttattaatcaacagttagatcaaaatcgtgaagaaagtttgaatcttttaaggaattctcataaagcggcacaatctagaagggtgaggacttcttcaccttatactgtgaattattacatgcaaatcaaatacatgatgattagaaatgtttggagaatcttcaacagtcctggtgttactttggttagattctttggtaacattgttatggcattagttattggatcgatgttttacaaagttgaaaaacatactactactgaaacattttattaccgtggtgcagctatgttttattccatcttaatcaatggattctcatcattaattgaaatttttgcacttttcgaagctagaccaattactgagaaacataagaggtattctttatatcgcccaagtgccgatgccttcgcatcttttctggctgacgttccagctaaagttgtgtccagtgtatgctttagtgtcatattctattttctggtgcattttagacgtgatcctgggagatttttcttttacttattgattaacatcgttgtctcatttgtcatgtctcatttattcagatgtgttggttcattatctaaaactatagtaggtgctatggtaccagcgtctatgcttctattatgcgtggcgctctatactgggttttctatcccgaaaagaagtatgcatggttggtccaaatggatttggtacattgatcccttatcatacttgtttgaagctttaatgacaaatgaattccatggtcgaaaattcccatgtgcgtcctacattccgaatggacctcaatatcaaaacaatactggagatcaaagagtttgttcagtggtaggatccgttccgggtcaaaactatgttcttggtgataattacattaagctaagttatgaatacgaaatcaagcacaaatggcgtggatttggagttggtatggcatatgtggtttttttcttctttctttacttgctcatttgtgaatacaatgaagccgctaaacagaaaggtgatttattagtttttcctcaaagtgtggttcgaaagatgcataaaagaaatgcattgaagcaacagacctttgattctgaagatattgaaaaaaattctgctctctctgcaaatgatgctacaaacaagactttaattacagattcttctgaagattctccagatgagcaaataaaagcaatttcacttcgtcaatctgattctgtggttcattggagagatttatgttatgaagttcgtattaaaagggaaagtaaaaggattttaaacaatatagacggttgggttaaacctggaacattaaccgccctcatgggcgcttcaggtgcaggtaaaacaactttgttggattgtcttgcagaaagagttactacgggtgttattactggtggtatattcgttgatggtaaattacgtgatgaatctttccccagatctattggttattgtcagcaacaggatttgcatctaaagacggctaccgttagagagtctttactgttttcagctatgttacgccaacctaagagtgttcctgcttctgaaaagagaaagtatgtggaggaagtcattaacgttcttgaaatggaaccctatgcagatgccattgttggtgtagctggtgagggtttaaatgttgagcagagaaaaaggttgaccataggtgtagaattggtagcaaaacccaaactattgatttttctagatgagccgacttctggtttagattctcaaacggcatggtccatctgtcaactaataagaaaattagcaaatcgtgggcaggctatcctgtgtacaattcaccagccttctgccgttttgatacaagaatttgaccggttgttattcttgcaaaaaggtggtgaaactgtctattttggtgagttgggtgatgaatgtaatatcatggtagattatttcgagcgcaatggagctcataaatgtccaccaaatgcaaatccggcagaatggatgcttgaggttgttggtgctgcgcctggtagccatgcaaatagaaactatcatgaagtttggaaaacttcaaaagaatatcaggaggttcagtgtgaacttgatcgtttggaaagggaacttaagggtcataatggtgatgaggacaatggagaaaggcataaatcttatgcaacggatattttcagccaaattgtaatagtatcgcatcgttttttccaacaatattggagatctccacagtatctatatcctaagctgtttttaaccgccttcaatgagatgttcattggcttcacttttttcaaagaaaagaaatcattacaaggtatacaaaatcaaatgttgtccacctttgttttttgtgtggttttcaatgcccttttacaacagtttttacctgtctatgtggagcagagaaatttgtatgaagctagagaacgtccctcacgcacattttcatggtttgctttcattgtttcacaaataatcgtagaggttccctggaatatcttagctggtacgataggattttttgtttattattaccctgtaggattttatcagaacgcctctgaagctcaccagctacatgaaaggggtgcactttactggttattctgtactgctttctttgtatgggttggttccatgggtatactggccaattcctttgtggagtatgcagctgaagccgccaatttagcgctgctgtgctttgcattctcattggccttcaacggtgttttagcgcctccagataaaataccccgtttttggattttcatgcacagagtttctccactaacctattatattgactctgcgttatcagttggtatggccaatgttgatgtgaaatgttcagattacgaatatgtcaagtttagcccttcggcaaatcagacttgtggtcagtacatggacccctatattaagtctattggtactggttatttagcaaatccaaatgctactgatcaatgtcgtttttgccccatctcgaaaacgaatgattttttgaaaactagaggctcgtattattcacataggtggaggaattatggtatattcatatgtttcattgcatttaattatgtcgctgccattttcttttactggttagcaagagtacctaaaggcaatagagtttctaagaagagtaagggctaa

SEQ ID NO: 184 - protein, 1498 aa, Zygosaccharomyces rouxii
MAEGSPSDSFVTADGQMAYGGFDEVTKNNVRNAVESFVKSNLDRSDLMKLDSSQEVAGINPIGLKEGDPDYDTRLDPNSDSFSSKEWIKNLAKIKEVDPDYFKPHKLGCCWKNLSVVGDSSDISYQSTFGNVPCKIIGWVSRYVRPSRKSHKFQILKSMDGIVNPGELLVVLGRPGSGCTTLLKSVSSNAHGVHVSEDSTISYNGIAPSEIKKHFRGEVVYNAETDIHIPNISVYQTLLTVARLKTPQNRIKGVDRESWANHIAEVAMAMYGLSHTRDTKVGNEVVRGVSGGERKRVSIAEVTICGSKFQCWDNATRGLDSATALEFVKALRAQADIENSAACVAIYQCSKDAYDLFDKVCVMHGGYQIYFGAAKDAKRYFEKMGYYCPSRQTTPDFLTSITSCAERIVNKEFIERDVFVPQTAEEMSDYWRSSQEFKELQQVINQQLDQNREESLNLLRNSHKAAQSRRVRTSSPYTVNYYMQIKYMMIRNVWRIFNSPGVTLVRFFGNIVMALVIGSMFYKVEKHTTTETFYYRGAAMFYSILINGFSSLIEIFALFEARPITEKHKRYSLYRPSADAFASFLADVPAKVVSSVCFSVIFYFLVHFRRDPGRFFFYLLINIVVSFVMSHLFRCVGSLSKTIVGAMVPASMLLLCVALYTGFSIPKRSMHGWSKWIWYIDPLSYLFEALMTNEFHGRKFPCASYIPNGPQYQNNTGDQRVCSVVGSVPGQNYVLGDNYIKLSYEYEIKHKWRGFGVGMAYVVFFFFLYLLICEYNEAAKQKGDLLVFPQSVVRKMHKRNALKQQTFDSEDIEKNSALSANDATNKTLITDSSEDSPDEQIKAISLRQSDSVVHWRDLCYEVRIKRESKRILNNIDGWVKPGTLTALMGASGAGKTTLLDCLAERVTTGVITGGIFVDGKLRDESFPRSIGYCQQQDLHLKTATVRESLLFSAMLRQPKSVPASEKRKYVEEVINVLEMEPYADAIVGVAGEGLNVEQRKRLTIGVELVAKPKLLIFLDEPTSGLDSQTAWSICQLIRKLANRGQAILCTIHQPSAVLIQEFDRLLFLQKGGETVYFGELGDECNIMVDYFERNGAHKCPPNANPAEWMLEVVGAAPGSHANRNYHEVWKTSKEYQEVQCELDRLERELKGHNGDEDNGERHKSYATDIFSQIVIVSHRFFQQYWRSPQYLYPKLFLTAFNEMFIGFTFFKEKKSLQGIQNQMLSTFVFCVVFNALLQQFLPVYVEQRNLYEARERPSRTFSWFAFIVSQIIVEVPWNILAGTIGFFVYYYPVGFYQNASEAHQLHERGALYWLFCTAFFVWVGSMGILANSFVEYAAEAANLALLCFAFSLAFNGVLAPPDKIPRFWIFMHRVSPLTYYIDSALSVGMANVDVKCSDYEYVKFSPSANQTCGQYMDPYIKSIGTGYLANPNATDQCRFCPISKTNDFLKTRGSYYSHRWRNYGIFICFIAFNYVAAIFFYWLARVPKGNRVSKKSKG

SEQ ID NO: 185 - DNA, 4530 bp, Saccharomyces kluyveri
atgtcgtccaacgatgaagaacaccgaaacaaggaggacgcacactccctgcagtcggaggattcctatgctcaatccatccactctttcaacgctacagacgatgaagcacaaaatgtcacctcccaactctcccgccacatcacgagtgttttgtcccaagaacagggtgtcgagcgtatcgagtctcttgcaagggtcttgtccaccaagaccaagcgcgagatggacaacttcgaagtcaactctttggactttgaccttcgcgagttactaaactacttgagaaaccatcaactgtcccagggtatcgaacccggtgattcgggtgttgcatttcgcagcttgaccgccatcggtatcgacgcttccgccgcttacggtccaagtgtcgaagagatggtccgttcctgggtcgatttccccaaacgccttgctcacaagatcatgcgcaagaaagatgaagttcccttgaggaacgtcattcaaaactgtaccggtgtcgtcgaaagcggtgaaatgctgttcgttgtcggtagaccgggggccggttgctcgactttgctaaagtgtgtttccggtgaaatctcagaactggttgaggttcaaggtgacttttcctacgacggtctggaccaagaagagatgatgtcaaagttcaagggctatgtcatctactgtcccgaactggatttccatttcccaagaatcaccgtcaaggagaccattgattttgccctaaaatgtaagacgcctcgtgtcagaatcgacaagatgaccagaaatcaatacgtcgactccatgagagatctatggtgtaccgtctttggtttgagacacacgtacgccacaaaagtcggtaacgattttgtgagaggtgtctctggtggtgaacgtaagcgtgtttccctggtcgaagccctggccatgaacgcctccatttactcgtgggataacgccacaagaggtttggatgcgtccaccgctttggaatttgcccaggccatcagaacagccaccaacatgatgaacaactctgcggtcgtggccatctaccaagccggtgaaaacatctaccagctgtttgacaaagccaccgtcttgtacagcggtagacaaatctactttggtccagccaccgaggcggttgggtattttgaaaacatgggctggatcaagccctccagaatgacctctgccgagtttttgacctctgtcacagtcgattttgaaaacagaactttggacatcaaaccggggtacgaagagaaaatccccaagtcctctgtagagtttgaaaactactggctaaactcttccgaataccaacaggttttggcccagtacgacgactactgcaacaggcaccctgcagaagacaccagggacagattggaaagagccaagtctcaaagattgcagcgcggtcaaagagccaagtctcagttcgtcgtcaacttctggtcccaggtttggtactgtatgataagaggtttccagagaaccaaaggtgatatgacttatacaaaggtctacctatcctctttcttgatcaaaggtttgattgtcggttccatgttccacaaaatcgatccgaaaagccagtccaccacagaaggtgcatactcccgtggtggtttgttattctacgtgctgttgttttgtgccgtcacgtcgctggctgaaatctcccactcttttgcaaacagaccaatcatcgtgaaacacaaatcctactccatgtaccacacctctgccgaagccctgcaagagattttcaccgaaatcccaacaaagctcactgccatcatatgtttgtcccttgtcagttattggatcccgtacttgaaatgggatgctggttccttcttccaatacttgttatacctgttcaccacacagcagtgtgcttcctttatcttcaaactggttgccaccttgaccaaagacggtggtactgcgcatgccctgggtggtctgtgggttttgatgctttccgtctacgccggttttgtcttgcctatcggtgaaatgcaccattggatcagatggttccattacttgaaccccttgacatacgcctacgagagtttggtctccaccgagttccacggcagacgtatgctgtgtagcaatttggttcctagcggtccaggttacgaatctgtttctctagtgaaccaagtctgtgatgcgctgggtgctgttaagggctctgcttatgtcgatggcgatgtctttgttttgaaaaaataccacttcagctacgaccatgcctggagaaactggggtatcaacattgtctggacctttggttacattgtgatgaacgttgtcatgtccgaatacctgaagccgcttgaaggcggtggtgatctgttgttgtacaagagaggccacatgcctgagctcggttctgaatctgccgatgccaaggttgcttcaagagaagagatgatggagtccctaaacggccccggtgtcgatttggaaaaagtcattgcagaaaaggacgtctttacttggaaccatctggactacactatcccatacgacggtagcacaagacagctgttgagcgatgtgtttggctatgtcaagcccggtaagatgaccgctttgatgggtgagtccggtgcaggtaagaccacgttgctaaacgtcttggctcaaagaatcaacatgggtgtcattactggtgatatgtttgtcaacgccaaacctttgccagactccttcaacagatcctgtggttacgtggcacaggcagacaaccatatggctgagttgtcggtcagggaatccctgaggtttgctgccgagttgagacagccaaaatctgttcctctggaagaaaaatacgagtatgtggaaaagatcatttccctgttgggtatgcaaaactacgccgaggccatcgttggtaagactggtagaggcttgaacgttgagcagagaaagaaactgtccattggtgtcgaactggttgccaaaccttccctactgttgtttttggatgagccaacctctggtttggattctcaatctgcctggtccattgttcagtttatgagagctttggccgactccggtcagtccattctttgtaccatccatcaaccttctgccactctgtttgagcagtttgacagactgttgttgttgaaaaagggtggtaagatggtctactttggtgacattggtgaaaactcccaagctttgttgtcctactttgagcgccaatctggtgtcaagtgtggcgagtctgaaaatcctgccgagtacatcttgaactgtatcggtgctggtgccaccgcttctgctgacgccgactggcacgacctgtggttggcttctcccgagtgtcaagccgccagagatgaggttgaagagctgcaccgggttttgccaagcaagccggttaaagacgacaaggaactggccggcaggtttgccgcttcctacctgacccagatgaagtgtgtgatgcggagaacctttatccagttctggagatcgcccgtctacatcagggccaagtttttggaatgtatcatctgtgctcttttcgtcggtttgtcctacgtcggtgtcaaccactctgttggtggtgccaccgaagccttctcgtccatctttatgatgttgttgattgccctggccatgatcaaccagctgcacgtctttgcatacgactccagagagttgtacgaggttagagaagctgcttccaacactttccactggagtgctttgctgctatgccacacttttgtcgagatcttctggtccaccatctgcgaattcttttgttacatctgctactactggccggctcagtacagcggcagagcgtcccatgctggttatttcttcttgatctatgtcttgatcttcccaatatattttgtcagctatggttgttggatcctgtacctgtccccagacgtgccatctgcctccatgatcaattccaacctgtttgcagccatgttgttgttctgtggtatcctgcagcctagagaaaagatgccaggtttctggaagagattcatgtacaatgtgtcacccttcacatacgtggtacaagctttggttgcgccattggttcacaacaagtctgtaaagtgtgagccacacgagctgaacgtcatggacccacccagcggccagaattgtggtgactttttgaagacctacatcgccaacaataccggctacttgctcaacccagatgccactgccaactgtgagtactgtccatacactgttcaggaccaggttgttgagcagttcaacgtcaagtggagctacaggtggaggaactttgggttcttgtgggcttacatctgtttcaactttggtgccatgctggtttgttattacgtcatgagagtcaaggtttggtcgttaaagtctattttggactttaagaagtggttcaacggacccaggaaggaaagacacgaaaaggatacaactattttccaaactcaacccggagatgaagctaaggtcaaaaagaactaa

SEQ ID NO: 186 - protein, 1509 aa, Saccharomyces kluyveri
MSSNDEEHRNKEDAHSLQSEDSYAQSIHSFNATDDEAQNVTSQLSRHITSVLSQEQGVERIESLARVLSTKTKREMDNFEVNSLDFDLRELLNYLRNHQLSQGIEPGDSGVAFRSLTAIGIDASAAYGPSVEEMVRSWVDFPKRLAHKIMRKKDEVPLRNVIQNCTGVVESGEMLFVVGRPGAGCSTLLKCVSGEISELVEVQGDFSYDGLDQEEMMSKFKGYVIYCPELDFHFPRITVKETIDFALKCKTPRVRIDKMTRNQYVDSMRDLWCTVFGLRHTYATKVGNDFVRGVSGGERKRVSLVEALAMNASIYSWDNATRGLDASTALEFAQAIRTATNMMNNSAVVAIYQAGENIYQLFDKATVLYSGRQIYFGPATEAVGYFENMGWIKPSRMTSAEFLTSVTVDFENRTLDIKPGYEEKIPKSSVEFENYWLNSSEYQQVLAQYDDYCNRHPAEDTRDRLERAKSQRLQRGQRAKSQFVVNFWSQVWYCMIRGFQRTKGDMTYTKVYLSSFLIKGLIVGSMFHKIDPKSQSTTEGAYSRGGLLFYVLLFCAVTSLAEISHSFANRPIIVKHKSYSMYHTSAEALQEIFTEIPTKLTAIICLSLVSYWIPYLKWDAGSFFQYLLYLFTTQQCASFIFKLVATLTKDGGTAHALGGLWVLMLSVYAGFVLPIGEMHHWIRWFHYLNPLTYAYESLVSTEFHGRRMLCSNLVPSGPGYESVSLVNQVCDALGAVKGSAYVDGDVFVLKKYHFSYDHAWRNWGINIVWTFGYIVMNVVMSEYLKPLEGGGDLLLYKRGHMPELGSESADAKVASREEMMESLNGPGVDLEKVIAEKDVFTWNHLDYTIPYDGSTRQLLSDVFGYVKPGKMTALMGESGAGKTTLLNVLAQRINMGVITGDMFVNAKPLPDSFNRSCGYVAQADNHMAELSVRESLRFAAELRQPKSVPLEEKYEYVEKIISLLGMQNYAEAIVGKTGRGLNVEQRKKLSIGVELVAKPSLLLFLDEPTSGLDSQSAWSIVQFMRALADSGQSILCTIHQPSATLFEQFDRLLLLKKGGKMVYFGDIGENSQALLSYFERQSGVKCGESENPAEYILNCIGAGATASADADWHDLWLASPECQAARDEVEELHRVLPSKPVKDDKELAGRFAASYLTQMKCVMRRTFIQFWRSPVYIRAKFLECIICALFVGLSYVGVNHSVGGATEAFSSIFMMLLIALAMINQLHVFAYDSRELYEVREAASNTFHWSALLLCHTFVEIFWSTICEFFCYICYYWPAQYSGRASHAGYFFLIYVLIFPIYFVSYGCWILYLSPDVPSASMINSNLFAAMLLFCGILQPREKMPGFWKRFMYNVSPFTYVVQALVAPLVHNKSVKCEPHELNVMDPPSGQNCGDFLKTYIANNTGYLLNPDATANCEYCPYTVQDQVVEQFNVKWSYRWRNFGFLWAYICFNFGAMLVCYYVMRVKVWSLKSILDFKKWFNGPRKERHEKDTTIFQTQPGDEAKVKKN

SEQ ID NO: 187 - DNA, 1314 bp, Saccharomyces castelli
atgaaaatgagaaaaatattacaaaacgttaacgcactagcagaagctggtgaaatggtgcttgtattaggtaggccaggagctggttgttcctctttcttaaaggttactgcaggtgaaactgaccaatttgctggtggtgtcacgggtgaaatcgcttatgatggtattcctcaagatgaaatgatgaagaaatacagagcagatgttatttataatggtgaactagatgtccatttcccatatttaacagttcaacaaacattggatttcgccattgcatgtaaaacaccagccaaaagagtgaacgatgtgtccaaagaggaatatattaaatctacaagagaactatatgctaccatctttggtctaagacatacatacaacaccaaagttgggaatgattttgtgagaggtgtatccggtggtgaacgtaagcgtgtctccattgctgaagctcttgctgccaacgggactatatattgttgggacaatgccactagaggtttagatgcatctactgcacttgagtacgctaaggctatccgtattatgacaaatcttttaaaatccacagcattcgtcaccatttatcaagctagtgaaaacatctatgaaactttcgacaaagtcacagtactatacagtggtagacaaatatattacggtcctattcatgaagctaaagactattttgcacaaatgggttatctatgtcccccaagacaagttacagcagaatttttaacggcattaactgatcctaacgggtaccatgaaattaaacctggatacgaacataaggtcccacgtaccgctgaagagtttgaaaaatattggttggaatctgatgaatacgcaaaattgagatctgacataaatacttataaaagtacagtcgatacagagaagacaagagaattatacaaggaatcgatggccgatgaaaaggctaaaggtactcgtaagaaatcgtattttacaatttcctatatggagcaagtgaaactctgtactattcgtggtttccaaagaatttatggtaacaaggcttatactgttattaatgttagttcatctgtcatccaagcatttattgtcggttcgaatttctatgcttctccttcatcaacaaatggtgcattctcaagagggggtgtcttatattttgcattgttattttattcgttaatgggtttagccaatatttcttttgatgatagacacattcttcaaaaacacaaaggttattccttgtaccatccatctgccgaagctattgcaagtacagtttcatctttcccatttagaatg

SEQ ID NO: 188 - protein, 438 aa, Saccharomyces castelli
MKMRKILQNVNALAEAGEMVLVLGRPGAGCSSFLKVTAGETDQFAGGVTGEIAYDGIPQDEMMKKYRADVIYNGELDVHFPYLTVQQTLDFAIACKTPAKRVNDVSKEEYIKSTRELYATIFGLRHTYNTKVGNDFVRGVSGGERKRVSIAEALAANGTIYCWDNATRGLDASTALEYAKAIRIMTNLLKSTAFVTIYQASENIYETFDKVTVLYSGRQIYYGPIHEAKDYFAQMGYLCPPRQVTAEFLTALTDPNGYHEIKPGYEHKVPRTAEEFEKYWLESDEYAKLRSDINTYKSTVDTEKTRELYKESMADEKAKGTRKKSYFTISYMEQVKLCTIRGFQRIYGNKAYTVINVSSSVIQAFIVGSNFYASPSSTNGAFSRGGVLYFALLFYSLMGLANISFDDRHILQKHKGYSLYHPSAEAIASTVSSFPFRM

SEQ ID NO: 189 - DNA, 4461 bp, Kluyveromyces thermotolerans
atgagcagctcttccgacaacggcggcaccacgccgtaccacgggctagacgagcacgccaaagacgagattcgtgagctcgcgcgcacgttcaccaatgcgtccgcgacgaacacgcacgcgtccgagggcggagcctcgacgcactcgacgcccggcatcaaccctgtgtttaccaacgccggctcccccgcttacaaccccaagctggacccgaactcggaggacttttcgtctgccgagtgggtccgcaacattagcagactcgtcatgagcgatcctgaccactacaagccttactccattggctgctcgtggaccaacctgcgcgcctacggtaactcgaccgacgtcgcgtaccagtccactgtggctaacctgccggttaagttgaccgaatttctgtacagaaacgcgcgcaaggcgcgcgctgaggacaccttcgacattcttaagcccatggacgggcagatcaaccccggagagcttctggtcgtcctgggacgtccaggttccgggtgttcgacactgctaaaatccatttcttccaatacccatggtttccacgtcgacaaggagaccactatttcctacgatggcatgacgcccaaagagatcaacaagcactacagaggtgaggttgtctacaacgccgaggccgatgtgcacttcccacacctgacggtctttgacactctgtacacagtagcattgctttcgaccccagagaaccgtatcgagggcgtcagccgtgaagatttcgcgaagcacgtgacagaggtcgccatggccacgtatgggctcctgcacaccaagaacaccaaggtgggtaacgagcttgtcagaggtgtctctggtggtgagcgtaagagagtatccatcgccgaagtctcgatctgtggttcaagattccagtgttgggataacgccacaagaggcctggattctgctacagctttagaatttgttaaggctctgcaaactaatgcaaagatgactctttcttcagcggccgtcgccatctaccaatgttctcaagacacttacgatttgtttgacaaagtgtgtgtcttgcatgagggatatcagattttctttggtcccgccaacgaagcaaaacagtacttcgaagagatgggctacgtgtgtcctgccagacaaaccactgcagactttctcacagccgtaaccaacccagctgagagaattgtgaataaagagaagacaaatatcccctcgaccgcccaagagatggaagcttactggaagcaatcagagaactatagacgtctgttgagaagtattgaagaatacaacagctctaacgccgaagaaaagcaagccgaactgcgtgaagcccacgttgctaagcaatcgaagcgctctaggccaggctctccttacacagtcagctacgggatgcaagtcaagtacttactccagagaaactttaagagaatccgtaatagcatgggactgacgctcttcatgatcatcggaaatggtagcatggccttcattttaggttcaatgttctacaagattctgaaacacgacagtacagcaagtttatactccagagctgccgcattattttttgcggtgttgttcaatgcattctcgtgtctgctggaaatcttggctctatatgaagccaggccaatctcagagaagcacaagcgttactcgctttaccatccatcggcggacgcgctcgcctccgttatatcagaggtgcccactaaacttctaacatccatcgtcttcaacattacactctactttttgtgcaacttcaaacggaatgcgggtgcattctttttctactttttgatgacccttgttgctacatttgctatgtcccatatttttaggtgtttgggagcagctacaaagacttatgcggagtccatggtacctgcatctgttctattgcttgccatgtcaatttacacaggtttcgcaatccctaagacaaagattcttggatgggctaagtggatatggtacatcaatcccctggcgtatatttttgagtccttaatggttaatgagttccacgaccgcagctttacatgctctcagtttattcccgctggtgccgggtatcaagatatctctggagttgaaagggtatgctcaagtgttggatccgaagctggccaaaccgtggttgaaggtgaaagatacatcaacattagttacggctattaccacagccacaagtggcgtggattcggtattggcatggcttacgcgatttttttcttgggtgtttacttggtcttcacagaattcaacgaaagcgccaagcaaactggtgaagttttggtattcactcactctacgttgaagaaaatgaagaaggagagaacgaagaagtctcaagatctcgagtacaatgccggtgctgtttctaccagtgagaaaaagcttttggaggaaagcagcgataacgggagctctacttcctccatggagggcgcccagttgagtaaatctgaagccatttaccactggagagacgtttgctacgacgttcaaatcaaaaaggacaccaggcggattttggatcacgttgacggctgggtcaaacctggcaccctgactgcactcatgggtgcatctggtgctggtaaaaccaccctgcttgactgcttggcatcaagagtaacgacaggtactatcacgggtgacatgtttattaacggttaccttcgtgactcgtcgtttgctagatctataggatattgtcagcaacaggatctgcatcttgaaactgctacagtgagagagtctttgaggttcgctgcctacttgcgtcaaccagcatcagtttccgttgaggagaaaaacaagtatgtggaagaggttatcaagattctggaaatggaaaaatattctgatgccgttgtcggcgtggcaggagagggtttgaatgttgagcagcgcaaaaggttgaccgttggtgtcgaattggcagctaagccaaaacttcttttgtttcttgatgaacctacgtctggcctcgactcccaaacagcttggtctatttgtcagttgatgagaagacttgccaatcatgggcaagccatcttgtgtacgattcaccagccttccgctttactgatgcaagaatttgataggctattgtttttgcagcgtggtggtagaaccgtttactttggagacttgggtgagggttgtcaaacaatgatcgactatttcgaaaagcatggtgcgcacccatgtccaaagggtgcgaaccctgcagagtggatgcttgaagttattggtgctgctcctggttcccacgcaaatcaggattacaatgaagtttggagaaactccgaggaatacaaagctgttcaggaagaattggagtggatggaaagagaactaccaaagaagccaatggacaattcggctgaacaaggtgaattcgcttcatctcttttctaccagtactatttagtgacgcaccgtttgtgtcagcaatactggcgtactccatcttatttgtggtcaaagacattgttgacaatcatttcccagctcttcattggatttacatttttcaaggcagacaactcattgcaaggtcttcagaaccagatgctttcagtctttatgttcacagttattttcaacccaagtttacagcagtatttgccaacttacatttcacaaagagatctttacgaagctagagaacgcccatctagaactttctcctgggtggccttcataatgtcgcaaatcacagttgagattccatggaacatcttgattggtaccattggctttttgtgctactactacccagtaagcttctacaggaacgcgtcttacgctggccagcttcacgaaagaggtgctttgttctggttgtacgctactgcgttttacattttcaccagctccatggctcaattatgtgttgcgggtcaggaggttgctgagtccgcaggacaaactgcatctttactttacaccatggcgctgtctttctgtggtgttatggtgacacccggtaatttgcctggtttctggaagtttatgtacagggtttcacctttgacctacttcattgatggcgtactatcaacaggtgtggccaattccaaggttgaatgctccagttacgagtttgttgaattttctcctcgttctgggcagacatgtgctgaatatatgtcgtcatacatctcttctactggtacaggttatctgaaggatcccgatgcaatggacaactgctcgttctgtacagtttcctcgactaattcatacctgagcgctgttagttccaactacgctcacagatggagaaattacggtatctttttgtgctacattttcttcaacttctgtatggcggtgttcttgtactggttggcaagagttcctaagaagaagaacagagtcgccgacgagagggaccccaacgcgaagaaatga

SEQ ID NO: 190 - protein, 1486 aa, Kluyveromyces thermotolerans
MSSSSDNGGTTPYHGLDEHAKDEIRELARTFTNASATNTHASEGGASTHSTPGINPVFTNAGSPAYNPKLDPNSEDFSSAEWVRNISRLVMSDPDHYKPYSIGCSWTNLRAYGNSTDVAYQSTVANLPVKLTEFLYRNARKARAEDTFDILKPMDGQINPGELLVVLGRPGSGCSTLLKSISSNTHGFHVDKETTISYDGMTPKEINKHYRGEVVYNAEADVHFPHLTVFDTLYTVALLSTPENRIEGVSREDFAKHVTEVAMATYGLLHTKNTKVGNELVRGVSGGERKRVSIAEVSICGSRFQCWDNATRGLDSATALEFVKALQTNAKMTLSSAAVAIYQCSQDTYDLFDKVCVLHEGYQIFFGPANEAKQYFEEMGYVCPARQTTADFLTAVTNPAERIVNKEKTNIPSTAQEMEAYWKQSENYRRLLRSIEEYNSSNAEEKQAELREAHVAKQSKRSRPGSPYTVSYGMQVKYLLQRNFKRIRNSMGLTLFMIIGNGSMAFILGSMFYKILKHDSTASLYSRAAALFFAVLFNAFSCLLEILALYEARPISEKHKRYSLYHPSADALASVISEVPTKLLTSIVFNITLYFLCNFKRNAGAFFFYFLMTLVATFAMSHIFRCLGAATKTYAESMVPASVLLLAMSIYTGFAIPKTKILGWAKWIWYINPLAYIFESLMVNEFHDRSFTCSQFIPAGAGYQDISGVERVCSSVGSEAGQTVVEGERYINISYGYYHSHKWRGFGIGMAYAIFFLGVYLVFTEFNESAKQTGEVLVFTHSTLKKMKKERTKKSQDLEYNAGAVSTSEKKLLEESSDNGSSTSSMEGAQLSKSEAIYHWRDVCYDVQIKKDTRRILDHVDGWVKPGTLTALMGASGAGKTTLLDCLASRVTTGTITGDMFINGYLRDSSFARSIGYCQQQDLHLETATVRESLRFAAYLRQPASVSVEEKNKYVEEVIKILEMEKYSDAVVGVAGEGLNVEQRKRLTVGVELAAKPKLLLFLDEPTSGLDSQTAWSICQLMRRLANHGQAILCTIHQPSALLMQEFDRLLFLQRGGRTVYFGDLGEGCQTMIDYFEKHGAHPCPKGANPAEWMLEVIGAAPGSHANQDYNEVWRNSEEYKAVQEELEWMERELPKKPMDNSAEQGEFASSLFYQYYLVTHRLCQQYWRTPSYLWSKTLLTIISQLFIGFTFFKADNSLQGLQNQMLSVFMFTVIFNPSLQQYLPTYISQRDLYEARERPSRTFSWVAFIMSQITVEIPWNILIGTIGFLCYYYPVSFYRNASYAGQLHERGALFWLYATAFYIFTSSMAQLCVAGQEVAESAGQTASLLYTMALSFCGVMVTPGNLPGFWKFMYRVSPLTYFIDGVLSTGVANSKVECSSYEFVEFSPRSGQTCAEYMSSYISSTGTGYLKDPDAMDNCSFCTVSSTNSYLSAVSSNYAHRWRNYGIFLCYIFFNFCMAVFLYWLARVPKKKNRVADERDPNAKK

SEQ ID NO: 191 - DNA, 4548 bp, Candida glabrata
atgcctgcttcaatatcctcttcgataatatcgaaggaaaggaaggatgatgcagatactacatcaaattcatatgctgattctgtgcatagttatgaaaacataaatcgtgacgataatgaacagcaacctgtttcaacacaattatctcgtcacttaacccaaattctctcagaagaaggtggtaaagaaagattggagtccatggccagagttatctccaccaagacaaaggctgaaatggacaaatttgaagtcaatgacatggacttcgacttgagaatgctgttgaattacctaagaaatagacagcttgaacaaggtatcgaaccaggtgactccggtgttgcttttaaaaatctaaccgcagttggtatagatgcttccgctgcctatggtccaagtgtggaggaaatgttaagagataccggtaaactaccacttacactgatcaacaagctaagaagaaagaaagatagtgttcctttgagaaacattatccaaaactgtactggtgttgttgaatctggtgaaatgttatttgtggttggtagaccaggtgctggttgctcaacattgctaaaatgtatctctggtgaaacctcagaattagttagcgttgatggtgaattttcctatgatggtttagatcaagaggaaatgatgaagaactacaaaggctatgtcatttactgtccagaacttgacttccacttccctaaaatcacagtgaaagaaaccattgattttgcactaaaatgtaaaactcctagagttagaattgacagaatgaccagaaaacagtatgtcgataatattagagatatgtggtgtactgtttttggtttaagacatacatacgctactaaagtcggtaatgattttgttagaggtgtctctggtggtgaaagaaagcgtgtgtctttagtagaagctcaagcgatgaatgcttctatttactcctgggataacgcaaccagaggtttagatgcttctacagctttagaatttgcacaagctattagaacagctaccaacatgatgaataattcagctattgttgctatttaccaagcgggtgaaaacatctatgaactatttgataaaaccacggttttgtataatggtaaacaaatttacttcggtccagctaagaaagctgtgcaatattttgagaatatgggttggataaaaccacctagaatgacatctgctgagtttttaacctctgttactgttgactttgaaaatagaactttagatatcaaacccggttatgaagatacaattcctaaatctggttttgagtttgaagaatattggttgaactctcctgaataccaagaactattgagacactacgatgattaccatgccagacaccctgctgaagaaactagagaaagatttgacactgcaaagaagcaaatgcttcaatcaggtcaacgtgaaagctcccgttatgttgtcaattactggtctcaggtttggtactgtatgatccgtggtttccaaagagttaaaggtgactctacttatacaaaagtctacctaagttcctttttaatcaaaggtttgattgttggttcaatgtttcataaaattgataataaaagtcaatccaccacagcgggcgcttattcacgtggtggtttgctattttatgttctattgtttgcctccgttacttctcttgctgaaattgctaactctttctctactagacccattattgtgaaacataaatcatactcgatgtaccacatttctgcagagtctctccaagaaattatcacagagttgccaaccaaatttgttgcaattattgttttatctttagtgacatactggataccatacctgaaatttgaagctggtgcatttttccaatacatcttgtatttattcactgtacaacaatgtacttcatttatctttaaatttgtcgctacaattacaaaagatggtgttactgcacacgctattggtggtctatgggttttgatgttatgtgtttatgccggttttgtgttaccattaggtgaaatgcatcattggattaaatggctgcatttcctaaatccactaacatatgcatttgagagtttagtatcgaccgaattccaccatagagaaatgctttgtagtcaattgattccaagtggtccagggtatgaaaatgtttccgttgctaatcaaatttgtaatgctgctggtgctataaaggggcatatgtttgtgaatggtgatacgtatattgatagacagtaccattttgcataccgccatgcctggagaagttggggtgtcaatattgtttggacatttggttatattgttttcaatgttattctttcggagtttatcaaaccagtatctggtggtggtgatttgttattgtacaagagaggccacatgccagagtttggtactgaaaatgctgatgctagagttgctagtagagaagaaatgatggaaactttaaatggtccagatgttgatttgccaaaggttatcgctgctaaggatgtctttacatggaaccacttgaattatactattccttatgatggtgccaccagacaattattatcagatgtttttggttacgttaagcctggtaagatgacagcactaatgggtgagtcaggtgctggtaaaaccactttactaaacgttttggcccaaagaattaatatgggtgttattactggtgatatgttagttaattctcagtcactacctgcatcttttaatagatcgtgtggttatgttgctcaagcggacaatcatatggctgaattgtcggttagagagtctttgagatttgctgctgaattaagacaacctagatctgttccattagaggaaaaatatgagtatgttgaaaagattatcgccttgttgggtatgcaaaattatgccgaagctttagttggtaaaacaggtagaggtctaaatgtggaacaaagaaagaagttgtcaattggtgtggaattagttgccaagccttccttattactattcttggatgaaccaacgtctggtttggattctcaatcagcttggtccattgtccaatttatgagagcattggctgactctggtcaatctattttgtgtactattcatcaaccttctgcaactttgtttgaacaattcgacagattactgttgctgaaaaaaggtggtaagatggtttactttggtgatattggtgaaaattcatctactttgttaaactattttgagcgccaatccggtgtgaagtgtggtatttcagagaatcctgcagagtatattctaaactgtatcggtgcaggtgctactgctagtgcatctgctgactggcacgatctatggcagcagtcacctgaatgtgcagcagccagggctgaattggatgaacttcataaaaaccttttgtcaagacctgttaccgaagatcctgaacttgtaacaaaatttgcggcctcatacacgacccaaatgaaatgtgttttaagaagaaccatgatacagttctggagatcaccagtgtatattagggctaagttcttggaatgtgtgtcatgtgctttgtttgttggtttgtcgtatatcgctgtcaaccactctgttggtggtgcaactgaagccttttcatctatctttatgttattgttgattgccctagcaatgatcaatcaattacatgtctttgcttatgacagtagggaattatatgaggttagagaagctgcgtctaacactttccattggagtgttctattgttatgtcactacgttgttgagacaggttggtctacactatgccaatttatgtgtttcatttgttactactggcctgccggatatagtggacgtgcttcgcatgcaggattcttcttcttcttctatgttttgattttcccaatgtattttgtttcatatggtctgtggattttgtacatgtctcccgatgtgccttcagcttctatgatcaattcaaacttatttgcagccatgttacttttctgtggtatcttacaaccaaaggaaaaaatgccaggattctggagaggtttgatgtacaacgtttctccattcacatatgttgttcaagcattagttggcccattggtacacgataagaaggttgtatgtaacaagaatgagtttgcaatcatggatccacctgcagggcaaacatgtggcgagtatctaagaacttatattggtaacaactcaggttacttagttaatcctcaagctacgagcaattgtaactactgcccatatagtgttcaagatgaagttgttgcccggttcaacgtgaaatggagttacagatggagaaactttggttttatgtgggtctacatctgcttcaacatttttgccatgttgtcttgttattacatcatgagagttaaggtttggagcttgaaatctgtccttgactttaagaaatggttcaacggaccaagaaaggatagacatgaaaaagacaagtctatctttgagaagaaaccaggtgatgaagaaaaagtgaagcaaaaattttaa

SEQ ID NO: 192 - protein, 1515 aa, Candida glabrata
MPASISSSIISKERKDDADTTSNSYADSVHSYENINRDDNEQQPVSTQLSRHLTQILSEEGGKERLESMARVISTKTKAEMDKFEVNDMDFDLRMLLNYLRNRQLEQGIEPGDSGVAFKNLTAVGIDASAAYGPSVEEMLRDTGKLPLTLINKLRRKKDSVPLRNIIQNCTGVVESGEMLFVVGRPGAGCSTLLKCISGETSELVSVDGEFSYDGLDQEEMMKNYKGYVIYCPELDFHFPKITVKETIDFALKCKTPRVRIDRMTRKQYVDNIRDMWCTVFGLRHTYATKVGNDFVRGVSGGERKRVSLVEAQAMNASIYSWDNATRGLDASTALEFAQAIRTATNMMNNSAIVAIYQAGENIYELFDKTTVLYNGKQIYFGPAKKAVQYFENMGWIKPPRMTSAEFLTSVTVDFENRTLDIKPGYEDTIPKSGFEFEEYWLNSPEYQELLRHYDDYHARHPAEETRERFDTAKKQMLQSGQRESSRYVVNYWSQVWYCMIRGFQRVKGDSTYTKVYLSSFLIKGLIVGSMFHKIDNKSQSTTAGAYSRGGLLFYVLLFASVTSLAEIANSFSTRPIIVKHKSYSMYHISAESLQEIITELPTKFVAIIVLSLVTYWIPYLKFEAGAFFQYILYLFTVQQCTSFIFKFVATITKDGVTAHAIGGLWVLMLCVYAGFVLPLGEMHHWIKWLHFLNPLTYAFESLVSTEFHHREMLCSQLIPSGPGYENVSVANQICNAAGAIKGHMFVNGDTYIDRQYHFAYRHAWRSWGVNIVWTFGYIVFNVILSEFIKPVSGGGDLLLYKRGHMPEFGTENADARVASREEMMETLNGPDVDLPKVIAAKDVFTWNHLNYTIPYDGATRQLLSDVFGYVKPGKMTALMGESGAGKTTLLNVLAQRINMGVITGDMLVNSQSLPASFNRSCGYVAQADNHMAELSVRESLRFAAELRQPRSVPLEEKYEYVEKIIALLGMQNYAEALVGKTGRGLNVEQRKKLSIGVELVAKPSLLLFLDEPTSGLDSQSAWSIVQFMRALADSGQSILCTIHQPSATLFEQFDRLLLLKKGGKMVYFGDIGENSSTLLNYFERQSGVKCGISENPAEYILNCIGAGATASASADWHDLWQQSPECAAARAELDELHKNLLSRPVTEDPELVTKFAASYTTQMKCVLRRTMIQFWRSPVYIRAKFLECVSCALFVGLSYIAVNHSVGGATEAFSSIFMLLLIALAMINQLHVFAYDSRELYEVREAASNTFHWSVLLLCHYVVETGWSTLCQFMCFICYYWPAGYSGRASHAGFFFFFYVLIFPMYFVSYGLWILYMSPDVPSASMINSNLFAAMLLFCGILQPKEKMPGFWRGLMYNVSPFTYVVQALVGPLVHDKKVVCNKNEFAIMDPPAGQTCGEYLRTYIGNNSGYLVNPQATSNCNYCPYSVQDEVVARFNVKWSYRWRNFGFMWVYICFNIFAMLSCYYIMRVKVWSLKSVLDFKKWFNGPRKDRHEKDKSIFEKKPGDEEKVKQKF

SEQ ID NO: 193 - DNA, 4236 bp, Saccharomyces cerevisiae
atgtctctttccaaatattttaatccaattcctgacgcttcagtcacctttgatggggctaccgttcaattggaagaatccctcggtgctgttcagaacgatgaagagtccgcatcggaattcaaaaacgtaggccatttagaaattagtgatatcacttttcgtgctaatgaaggtgaagtcgtcttagtactgggaaacccaacatcagcgctcttcaaaggtctattccatggtcacaagcatctgaaatactcgcctgaagggtctattagattcaaagacaatgagtacaaacagtttgcttccaaatgcccccatcagatcatttataataacgaacaagatattcacttcccgtatctgacggtggagcaaaccattgattttgcgttgagttgtaagtttcacattcccaagcaagagcgtattgaaatgagagacgagttattaaaagagttcggactgtcgcacgtaaagaagacgtatgtgggtaatgactacgttcgtggtgtttctggaggtgaaaggaaacgtatctccattatagaaacgtttattgccaatgggtctgtttacttatgggacaactcgacgaagggtttggactctgccaccgccctagaatttctttccattacccaaaagatggcaaaagctacaagatcggtgaattttgttaaaatttctcaagcaagcgacaaaattgtcagcaagtttgacaagattcttatgttaggtgattccttccaggtgttttacggaaccatggaggagtgtttaacccattttcatgacaccttacagataaaaaaaaaccctaacgattgtattattgaatatttaacatcaatcttaaattttaagttcaaggaaacgtctaattccattgttggtcttgacactccatctgttgtttctgaagaaaatcaagctttaaacatcaataatgaaacagatttgcatacattatggattcagtctccatactataaacactggaaggccatcacttcaaaaacagtgcaagaatgcaccagaaaagatgttaatccggatgatatctcccccatttttagtattccgctaaagacgcaactgaaaacgtgcactgtaagagctttcgaaagaatcattggtgacagaaactacttgatttctcaatttgtttctgttgtggtgcagtctttggttattgggtcccttttttataacattcccctgacaacaattggttcgttttctagaggatctttaactttcttttccatcctattctttacatttctttctctcgccgacatgcctgcttcctttcaaaggcaacccgtcgttcgtaaacatgtccagctccatttttattataattgggtggaaactttagcaacaaattttttcgattgctgctctaaatttatactggtggttatttttacaatcatactttactttttggcccatttacagtacaatgcagctaggtttttcatctttttgcttttcctttccgtctataatttttgcatggtgtcactatttgcattaactgctttgatcgctccaactctatcaatggcaaacctattggccggtatcttactgttagccattgccatgtacgcgtcctatgttatttatatgaaagatatgcatccatggttcatatggattgcatatttgaatcctgctatgtttgccatggaagccattttgagtaacgaattgtttaacctgaaactagactgtcatgaaagtattattcccagaggtgaatattatgacaatatttcattcagtcataaagcttgtgcctggcaaggcgctaccctaggtaacgattacgtcagaggccgtgattatttaaaaagtggattgaaatacacttaccatcacgtgtggagaaatttcggtattatcattgggtttctgtgtttcttcctattttgctctttactagcagcggaatatatcacgcctctgtttactagagaaaatttattgcgctggaataactatctcaaaagatactgtccctttctgaatagccaaaaaaagaataataaaagcgctattaccaacaacgatggcgtatgtactcccaagaccccgatagccaatttttccacttcatcctcttctgttccatcagtctcgcatcaatacgatactgattacaatattaaacatccagatgaaactgttaacaatcatactaaggaatccgtagctatggaaacgcaaaagcacgtcatctcctggaaaaatatcaattataccattggagacaaaaaattgatcaacgacgcttctggatatataagttccggattaactgccctaatgggtgaatctggtgctggtaagacaactttgttgaatgtcttgtctcaaaggaccgaaagcggggttgttaccggtgaattattaatcgatggacagcccttaacgaatattgatgcattcagaagaagtatagggttcgttcaacagcaagatgttcatttagagctcttaactgtgagagagtctttggaaatttcctgcgtcctaagaggtgatggggatagagactatttaggagttgttagcaacctattaagattgccttcggaaaaactggttgctgatttatctccaactcaaagaaaattattatctattggtgttgaattggtcactaagccttctctgttgttattcctagatgaacctacttcagggctagacgccgaagcagctttaaccatcgtgcaatttctgaaaaagctttcgatgcaaggtcaggctatcttatgtactattcatcagcctagcaaaagtgtcatcagctattttgataacatctatttactaaaaagaggtggtgagtgtgtctattttggttcattacctaatgcctgtgactattttgtagctcacgatagacgcctaacatttgacagagaaatggataatccggctgatttcgttattgacgttgttggtagcggaagtacaaatattccaatggatgatgcagagaagccaacctcaagcaaaattgatgagccagtatcttaccataagcaatctgattcaattaactgggcagaactctggcaatcctctccagaaaaagtgcgggttgctgatgatttgcttttattagaagaagaagcccggaaatctggtgttgatttcactacgtccgtatggagtccgccttcgtatatggaacaaataaagttaatcacaaagagacagtacatttgtaccaagagagacatgacctatgttttcgctaaatatgctttgaatgctggcgctggactattcattggattttcattttggaggacaaagcataatatcaacggtctgcaagatgctattttcttgtgcttcatgatgctttgtgtttcctcccctttgatcaatcaggttcaagataaggctttgcaatctaaagaagtatatatcgccagggaagcgagatctaatacttatcattggaccgttcttttgattgctcaaactattgttgaattaccattagccatttccagttctaccttatttttcctgtgttgctacttctgttgcggtttcgaaacctctgcccgtgtagctggtgtcttttacttgaattatattttattttccatgtattatttgtcatttgggttgtggcttctatattctgcccccgatttacaaactgccgctgtctttgttgccttcctctatagtttcacagcttcattctgtggcgttatgcaaccatactcgttattcccaagattttggacattcatgtacagggtttcaccatacacgtatttcattgaaactttcgtaagcttacttctccatgacagagaagtaaactgctcgacaagtgaaatggtaccaagccaacctgtaatgggtcaaacctgcggtcagtttatgaaaccctttattgatgaatttggtgggaaactgcacatcaataacacatacaccgtctgcgcctactgcatgtacactgttggggatgacttccttgctcaagaaaatatgagttatcatcacagatggagaaattttggttttgaatgggttttcgtttgctttaacattgccgccatgtttgtgggcttctacctaacctacatcaaaaaaatttggccttctgtgattgatggtataaagaagtgtatcccatcaatgaggcggtccaaaacatctcataatccaaacgaacaaagcgtataa

SEQ ID NO: 194 - protein, 1411 aa, Saccharomyces cerevisiae
MSLSKYFNPIPDASVTFDGATVQLEESLGAVQNDEESASEFKNVGHLEISDITFRANEGEVVLVLGNPTSALFKGLFHGHKHLKYSPEGSIRFKDNEYKQFASKCPHQIIYNNEQDIHFPYLTVEQTIDFALSCKFHIPKQERIEMRDELLKEFGLSHVKKTYVGNDYVRGVSGGERKRISIIETFIANGSVYLWDNSTKGLDSATALEFLSITQKMAKATRSVNFVKISQASDKIVSKFDKILMLGDSFQVFYGTMEECLTHFHDTLQIKKNPNDCIIEYLTSILNFKFKETSNSIVGLDTPSVVSEENQALNINNETDLHTLWIQSPYYKHWKAITSKTVQECTRKDVNPDDISPIFSIPLKTQLKTCTVRAFERIIGDRNYLISQFVSVVVQSLVIGSLFYNIPLTTIGSFSRGSLTFFSILFFTFLSLADMPASFQRQPVVRKHVQLHFYYNWVETLATNFFDCCSKFILVVIFTIILYFLAHLQYNAARFFIFLLFLSVYNFCMVSLFALTALIAPTLSMANLLAGILLLAIAMYASYVIYMKDMHPWFIWIAYLNPAMFAMEAILSNELFNLKLDCHESIIPRGEYYDNISFSHKACAWQGATLGNDYVRGRDYLKSGLKYTYHHVWRNFGIIIGFLCFFLFCSLLAAEYITPLFTRENLLRWNNYLKRYCPFLNSQKKNNKSAITNNDGVCTPKTPIANFSTSSSSVPSVSHQYDTDYNIKHPDETVNNHTKESVAMETQKHVISWKNINYTIGDKKLINDASGYISSGLTALMGESGAGKTTLLNVLSQRTESGVVTGELLIDGQPLTNIDAFRRSIGFVQQQDVHLELLTVRESLEISCVLRGDGDRDYLGVVSNLLRLPSEKLVADLSPTQRKLLSIGVELVTKPSLLLFLDEPTSGLDAEAALTIVQFLKKLSMQGQAILCTIHQPSKSVISYFDNIYLLKRGGECVYFGSLPNACDYFVAHDRRLTFDREMDNPADFVIDVVGSGSTNIPMDDAEKPTSSKIDEPVSYHKQSDSINWAELWQSSPEKVRVADDLLLLEEEARKSGVDFTTSVWSPPSYMEQIKLITKRQYICTKRDMTYVFAKYALNAGAGLFIGFSFWRTKHNINGLQDAIFLCFMMLCVSSPLINQVQDKALQSKEVYIAREARSNTYHWTVLLIAQTIVELPLAISSSTLFFLCCYFCCGFETSARVAGVFYLNYILFSMYYLSFGLWLLYSAPDLQTAAVFVAFLYSFTASFCGVMQPYSLFPRFWTFMYRVSPYTYFIETFVSLLLHDREVNCSTSEMVPSQPVMGQTCGQFMKPFIDEFGGKLHINNTYTVCAYCMYTVGDDFLAQENMSYHHRWRNFGFEWVFVCFNIAAMFVGFYLTYIKKIWPSVIDGIKKCIPSMRRSKTSHNPNEQSV

SEQ ID NO: 195 - DNA, 4455 bp, Saccharomyces kluyveri
atgtctcagcctagtactagtagctcatctgaagctgatgatgatgtttcgttcaacaggtctaaggcaatcgaataccgttctggtgttgtctcagagactccaattgatcacgtgacaagaataatgtctaggcggtctaccatcgatgagcaacaaaatccggatcaaacagatccggaagtaatctctaaagttgagaccttagcacggaccctatcgaaacacagggctagagacggtcctctacaaatagatccaaatgatttcgatgccgcggcgattttatccgctttcgtcagagactccgaggagcaaggaattcacataaggaaatccggtgttattgctgaagatgtctcagtaactggtgtagatgccaggtttttggaaggccaaacttttggagatattctgatgttgccaagaaccgtctttcgtggcatcagggcttctaggcataaaaaaatgagaaaaatcattcaaggtgtgaatttgttggctcttcctggtgagatgatcttagttttagggagaccaggtgcgggatgctcgagttttttgaaaaccatttctggtgaggttgaccaattcccagaagtcacaggtgacatctcatacgacggtattccacagaaagacatgatgaagaaatacaagcccgatgtaatttacaatggtgaaatggatgtccatttccctcacttgactgtcaagcagactcttgattttgcacttgcctgtaaagttccaagcgtcagagtcaacaacgcctccagaaaacagtacattgcctccatgagagagttatacgcaacgatctttggcctaagacacacatacaataccaaggttggtaacgattttgtgagaggtgtttctggtggtgaacgtaaaagagtttctattgctgaagctttggctgcaagaggttctatctattgttgggacaacgccacgagagggttggacgcatccactgcgttggaatatgcacaggctatccgtatcatgactaacttattgaaatccaccgctttggttacgatttatcaagcaagtgaaaatatctacgagaccttcgacaaagtgaccgttttgtatgacggtagacagatttatttcggtaccgttacaagtgctaaggattattttgaaaggatgggcttcatctgccccccaagacaagctactgcagaatttctaacagctctaacagatgctgatgggcttcacgacatcaaaccaggctacgaaaacaaggttcctagaaccgctgcagaatttgaagcgtattggagggcgtctccagaattttcacagctaaaaaatgaaattgaggcatataaaaaccaagttgaagctgaaaagacaaaggagttatacgatctttcattatcgcaagaaaagtccaaatatacccggtccaaatcctactttaccatctcttacttccaacaagttaaattgtgcacaatccgtgggttccaacggatttatggtgataaagccttcacaataacaaatactgttgccgctatcgtccaatctttggttactggctctttgttttacagtacaccttctagtacgtcgggtgcattttctagaagtggtgtattgtacttctcggttttatactactctttgatggggttggccaatattagttttgaagacagaccaattctacaaaagcataaaacttattcattgtaccatccatctgctgaagccttagccagcaccatctctgccttcccatttagaatggtgggcttaacctgttttttgatcatcttgtactttttgtctggtttgactagagaggcaggtagattctttatagtctacctgttcctaacaatttgctccgagtctattaccgcattgtttgaaatggttaccgctatctcggatagtatttcccaggcaaattccatttctggtattcttatgatggcaatttcgctatattctacatatatgatccaattgccttctatgcacccatggtttaaatggattgcttacattttgcccatcagatacacttttgaaagtatgttgagtgccgaatttcacaacagaaaaatggactgtggtaacactttggttccaagtggtcctggttatcaaaacgtgagttccgacaaccaggtatgtgcatttatcggttctaaggaaggtcagtcatgggttcttggtgacgactatttgaagttacagtatgaatacaaatactctcatgtttggagaaacttgggtatcatgtttgcctttctttgtttctacttaactgtcaaatgtcttgttacagaatttaaaaggcctatcaaaggcggtggagacgctttgctttttaaaaagggtacgagaaatagaccatcacctactgatgaggaaagctccgacaatgaattgactatcgcagacgcaaaaaaagtaagctctgggggttcttctacggaaactgccgttttcgaagggttgcaaagcgaaggtgtcttcctttggaaagatgtctgctacactatcccattcaaaggtggacagcgtcaactgttggacaacattagcggttactgtgccccaggtacacttactgctttgatgggtgaatctggtgctggtaagactactctgttgaatacgttagctcagaggaatgtaggtatcatcactggtgacatgttagtcaatggtagtccaattgatgcaagtttcgaaagacgtacgggttatgttcaacagcaagatatacatattaaggaaatgaccgtcagagaatctttgcaattttccgccagaatgcgcagacccgaatctatccctgacagcgaaaaaatgtcatatgtggagaagcttattgaaatattgggtatgcaagagtatgctgacgctttggttggtgatgttggctacggtttgaatgttgaacagaggaagaaactgtccattggtgtagaactagctgctaagcctaacttgttgttatttttagacgaacctacctctggtttggattcccaggcatcttgggccattgtacagcttttgaaaaaacttgctcaagcgggtcaatccattttgtgtacaattcatcaaccttctgctacgttgttcgaacaatttgacagattattgctgctaaagaagggtggacaaacagtttactttggtccaatcggcgagcattctagagttttattagactattttgaaaggaatggagcaaggcaatgtgaagatagtgaaaaccctgctgagtacatcctagaatctattggtgccggtgctacagcctcggttaaagaagattggcatctcaaatggaaggcatctccagaattccaagaaacaaacacacaagttgaagcttacatcaaagagcttttcggaaagcgtgatccggcagatgacggaaagtcctcgcccagcaagtatgccacctcttatttctatcaatttagatatgtctggcagagatcgtccgtaatgttttggagagacgttaactatatcatgtcaaagatgatgttgtttttagtgggtggtttgttcattggttttactttctacaacgttggctctagttttaccggtctgcagaatgcgatgtttgctgccttcatggcaattgtgctatctgccccagccatgaatcaaattcaggctcgtgcattagcttcgagagagttattcgaagtgagagagtccaagtctaatatgtttcactggtcttttctgttattgacacagtacttaactgaactaccataccatttattcttttccacagtttttttcgtctctttctatttccccttgagaaccgactttgcagcttctaaatcgggcgtctttttcctcgattactgtatcatgttccaactatactttgtaggcctgggcctagcggtgttatacatgtctccaaacctaccgtcggctaatgttattcttggtctgttcctatcattcttaatttccttctgtgggattgttcagccatctagtttaatgccagggttctggacatttatgtggaaggtttcgccatacacttacttcactcaaaacttaatcggcataatgctgcatgataagaaggtcatttgcaaggccaaagaatattcatacctagatccaccaacgggcaaaacctgcggtgagtacatggaaccattcctcaagtttgcgtctggttatgtcaagaatcctgatgctactgaaaaatgtgcatactgtacttacaaagtcggtgatgaatatttaaagagaattggtagtagttacagttacatgtggagaaactttggctttttctgggtatacatcatcttcaacctggcagcaatgattatattgtactacctattccatgtgaggaaaatatctttgaaagactctaaactgacaagggcctttatgagcaaggttaaaaaggaataa

SEQ ID NO: 196 - protein, 1484 aa, Saccharomyces kluyveri
MSQPSTSSSSEADDDVSFNRSKAIEYRSGVVSETPIDHVTRIMSRRSTIDEQQNPDQTDPEVISKVETLARTLSKHRARDGPLQIDPNDFDAAAILSAFVRDSEEQGIHIRKSGVIAEDVSVTGVDARFLEGQTFGDILMLPRTVFRGIRASRHKKMRKIIQGVNLLALPGEMILVLGRPGAGCSSFLKTISGEVDQFPEVTGDISYDGIPQKDMMKKYKPDVIYNGEMDVHFPHLTVKQTLDFALACKVPSVRVNNASRKQYIASMRELYATIFGLRHTYNTKVGNDFVRGVSGGERKRVSIAEALAARGSIYCWDNATRGLDASTALEYAQAIRIMTNLLKSTALVTIYQASENIYETFDKVTVLYDGRQIYFGTVTSAKDYFERMGFICPPRQATAEFLTALTDADGLHDIKPGYENKVPRTAAEFEAYWRASPEFSQLKNEIEAYKNQVEAEKTKELYDLSLSQEKSKYTRSKSYFTISYFQQVKLCTIRGFQRIYGDKAFTITNTVAAIVQSLVTGSLFYSTPSSTSGAFSRSGVLYFSVLYYSLMGLANISFEDRPILQKHKTYSLYHPSAEALASTISAFPFRMVGLTCFLIILYFLSGLTREAGRFFIVYLFLTICSESITALFEMVTAISDSISQANSISGILMMAISLYSTYMIQLPSMHPWFKWIAYILPIRYTFESMLSAEFHNRKMDCGNTLVPSGPGYQNVSSDNQVCAFIGSKEGQSWVLGDDYLKLQYEYKYSHVWRNLGIMFAFLCFYLTVKCLVTEFKRPIKGGGDALLFKKGTRNRPSPTDEESSDNELTIADAKKVSSGGSSTETAVFEGLQSEGVFLWKDVCYTIPFKGGQRQLLDNISGYCAPGTLTALMGESGAGKTTLLNTLAQRNVGIITGDMLVNGSPIDASFERRTGYVQQQDIHIKEMTVRESLQFSARMRRPESIPDSEKMSYVEKLIEILGMQEYADALVGDVGYGLNVEQRKKLSIGVELAAKPNLLLFLDEPTSGLDSQASWAIVQLLKKLAQAGQSILCTIHQPSATLFEQFDRLLLLKKGGQTVYFGPIGEHSRVLLDYFERNGARQCEDSENPAEYILESIGAGATASVKEDWHLKWKASPEFQETNTQVEAYIKELFGKRDPADDGKSSPSKYATSYFYQFRYVWQRSSVMFWRDVNYIMSKMMLFLVGGLFIGFTFYNVGSSFTGLQNAMFAAFMAIVLSAPAMNQIQARALASRELFEVRESKSNMFHWSFLLLTQYLTELPYHLFFSTVFFVSFYFPLRTDFAASKSGVFFLDYCIMFQLYFVGLGLAVLYMSPNLPSANVILGLFLSFLISFCGIVQPSSLMPGFWTFMWKVSPYTYFTQNLIGIMLHDKKVICKAKEYSYLDPPTGKTCGEYMEPFLKFASGYVKNPDATEKCAYCTYKVGDEYLKRIGSSYSYMWRNFGFFWVYIIFNLAAMIILYYLFHVRKISLKDSKLTRAFMSKVKKE

SEQ ID NO: 197 - DNA, 4452 bp, Kluyveromyces lactis
atggagggttcaaacaatggattgagcagtcgtcctgagaaattggacggagatcctcgatcaactagtgataccagcagcagtggtagttgtacttctctgaaagagttcagtggtaacaaccatgaacttcatcaggatactgaccaacaggtagttaaggatgctgctgaggatccagcgtttctgaaaaaagtagagactctttctaggtcattgtcccgtcgtactacgactctttctgagtgggatgaggtcgatgagaacttcgatatgtacagagagatccaggggatccttaaggcgtccaacgatggtggtatccatttgaggaaggccggtatcaccgccagaaacgttgctgtaaagggtgttgacgctcagtttcttgaaggtgccacttacggtgatatgctaatgttacctgcaactatattcaagggaattaagaaggccagacaaacaacattgagagatatcattagcaatgtaaatctacttgttaggcctggtgagatgttgcttgtattgggtagaccaggttctggttgttccactttcttaaaaacaatggctggtgagctatctcatttcaagggtgtctcaggtgacatctcgtacgacggtgtctcacaaaaggatatgttgaagtatttcaagtcggatgttatatacaacggtgaaatggatgtccatttcccgcatttgactgtgcaacagactttagattttgctgtcgcttgtaagactccaagcaaaagaattaacgattttaccagacaacagtatatcgaattcatcagagacttatatgcaacaattttcggtttgaagcacacttataacactaaagttggtgatgatttcgtgagaggtgtctctggtggtgaacgtaagcgtgtttccatcgcagaagctttggccgctcgcggttccatatattgttgggataacgctactcgtggtctcgatgcttctactgctcttgaatatacagaagctatcagatgtatgacaaacttactaaagtccactgcgttgattactgtgtaccaagcaagtgaaaacatctatgagactttcgataaggttaccattctctacgaaggtaaacaaatatatttcggtcgcattgaagaggctaagaagtatttcgaaaacttggggttcatctgtccagcaaggcaagcaacggctgaatttttgacctctttaactgattctaaaggtttacgcagagtaagacctggtttcgaaaacaaagtcccaagaaccagagacgatttcgtcagggtttgggaagagtccaaagaatatcatgacttaatacaaagtatcgaacattacgaaacgaaagaagtcgatggtgcgaagactatccagttcttcaaagaatcgatggttgaagagaaagataaggcttcgagaaagaagtctaaatttactatttcctattgggctcaaatcaggctctgtaccaggagagggttccaaagaatttatggtgataagtcttttactatcacaaacactgttgctgctatcattcaagccttggttactggttccctattctacaacaccccaagtagtactcaaggtgctttctctcgtggtggtgttttatatttcgctattctatatttctctttgatgggtttagccaacatcagtttagcaaacagacctatcttgcagaaacatatcgcttactcattgtatcatccatctgctgaagcacttgcttctactatctctaatgccttcttcagaatgatttcgttaaccgctttcctaatcatcctttacttcttatctggtttgactcgtaacgctggcagattcttcatggtgtatttgtttgtggcgctcgcatccgagtcaatcaatgccttgtttgaatttatcactgctgcgtgtgactcaatttctcaggctaatgctattgcaggtttggtgatgatggccttatccttatactccacctatatgattcaaactccttctatgcatccatggtttgaatggatctcttacattctaccattgagatatgcttttgagaacatgctaaacgctgaatttcatgcaagaaggatggattgcggtggtactttagtaccaacgggtcctgtttacgagaatgtcagtagtgaatacaaggtctgtgcgttcatcggatctcagccaggtgaatcgtatgttttgggtgataactatttgaaacttcagtacgactactcatattcacaccaatggagaaatttcggtattttgatcgcatttttggtcggtttcctcgtcttcaagtctgttatcactgaattcaagacccctattaagagtagtggtgatgctttactcttcaaaaagggtaccagcttgaacaccattccaaaagacgaagaaagcaatgttaacagtactgattccattacgaagaccactgatagctcatctaggtcggacgacccagcactatttgctgatatgagaagtgaaggtatcttcctatggaaggatatctgttatactatcccttataaaggcggcgaacgtctgttattggataacgtatctgggtatgttaaacctggtactttgactgccttgatgggagaatctggtgcaggtaaaactacattgctaaacacacttgctcaaagaactgacattggtgttgtcactggtgacatgttggtaaatggtaagccaatcgacgcctcattcgaaagaagaacgggttacgttcaacaacaagatgttcacatcaaagaaatgacagtcagagaatctctacaattctcagcaagaatgagaagaccactaactgttccagatgaagaaaaacttgattacgttgaaaaggttattgaaatcttggacatgtccgcttacggtgaagctttagtcggtaatattggttatggtttgaacgttgagcaaagaaagaagttatcaattgctgttgaattggttgccaaaccgaacttgttgttgtttttggacgaaccaacttctggtttagattctcaatctgcctgggccattgttcagttgttgaagaaattagccggcgccggtcaatcaattttgtgtaccatccatcaaccttctgctactttgttcgaagaattcgacagattgttattattgcgtaaaggtggtcaaactgtgtactttggtgacatcggtgaacactcttctacgttgttatcatactttgagagaaatggtgcacgtaggtgtgaagaaaaggaaaatccggccgagtatattttggaagccattggtgccggtgctacagcttccgttaaggaagattggcacgaaaaatggattaaatcatcagaatttgtttctgttaaccaagaaatcaacgacttaatcgaaaagctagcccaccaaccaaatgacgattcttccactgaattgattactaaatatgctacaccatattggtaccaattcgtttatgttttaagacggaccatggttatgttctggagagatgtggactacttaatggctaagaccatgttgtatatcagcagtggtttgttcatcggtttcaccttctataatgtgggtacttctttcgtcggtctacaaaatgcgatgtttgctgcatttatggcttgtattgtttctgccccagcaatgaatcaaattcaggctcgtgccctacaatcaagagaattatatgaagttagagaatccagatctaacatgttccactggagttgtatgttgttctcacaatatatcactgaattaccgtaccaattatggtgtagtaccttattctttgtatccttctatttcccattgaaggcagaatacacaagtttgaaagccggtttattctacttgaactactgtgtcattttccaattatactgtgttggtttgggtttagctgtgttgtacatgtctccagatcttccaagttcaaacgtcattatgggtttactactctccttcatgattaccttctgtggtgttgtgcaacctgttaatctaatgcccggtttttggacctttatgtggaaggtatccccgtacacgtatttgattcaaaatttcgtttctttgatgttacatgacaaaacagtcatctgtaccgataaggaactgtcttactttaacccaccaccgggatcaacttgtggatcttacatgactgactatttcactgaagggttcggttatattaagaacccagaggccaccagcaactgtgcttactgcagatacaagatcggtgatcaatacctatcttacatttctgctaaatatgctgatctatggagaaactttggtttcttatgggtttacatctgctttaacttaatcgcaatggtttcattatattacatattccatgttaagcgtttcagcccaaagtctttggtaatgggcgttgttggtaaattcaagaaagaaaaatga

SEQ ID NO: 198 - protein, 1483 aa, Kluyveromyces lactis
MEGSNNGLSSRPEKLDGDPRSTSDTSSSGSCTSLKEFSGNNHELHQDTDQQVVKDAAEDPAFLKKVETLSRSLSRRTTTLSEWDEVDENFDMYREIQGILKASNDGGIHLRKAGITARNVAVKGVDAQFLEGATYGDMLMLPATIFKGIKKARQTTLRDIISNVNLLVRPGEMLLVLGRPGSGCSTFLKTMAGELSHFKGVSGDISYDGVSQKDMLKYFKSDVIYNGEMDVHFPHLTVQQTLDFAVACKTPSKRINDFTRQQYIEFIRDLYATIFGLKHTYNTKVGDDFVRGVSGGERKRVSIAEALAARGSIYCWDNATRGLDASTALEYTEAIRCMTNLLKSTALITVYQASENIYETFDKVTILYEGKQIYFGRIEEAKKYFENLGFICPARQATAEFLTSLTDSKGLRRVRPGFENKVPRTRDDFVRVWEESKEYHDLIQSIEHYETKEVDGAKTIQFFKESMVEEKDKASRKKSKFTISYWAQIRLCTRRGFQRIYGDKSFTITNTVAAIIQALVTGSLFYNTPSSTQGAFSRGGVLYFAILYFSLMGLANISLANRPILQKHIAYSLYHPSAEALASTISNAFFRMISLTAFLIILYFLSGLTRNAGRFFMVYLFVALASESINALFEFITAACDSISQANAIAGLVMMALSLYSTYMIQTPSMHPWFEWISYILPLRYAFENMLNAEFHARRMDCGGTLVPTGPVYENVSSEYKVCAFIGSQPGESYVLGDNYLKLQYDYSYSHQWRNFGILIAFLVGFLVFKSVITEFKTPIKSSGDALLFKKGTSLNTIPKDEESNVNSTDSITKTTDSSSRSDDPALFADMRSEGIFLWKDICYTIPYKGGERLLLDNVSGYVKPGTLTALMGESGAGKTTLLNTLAQRTDIGVVTGDMLVNGKPIDASFERRTGYVQQQDVHIKEMTVRESLQFSARMRRPLTVPDEEKLDYVEKVIEILDMSAYGEALVGNIGYGLNVEQRKKLSIAVELVAKPNLLLFLDEPTSGLDSQSAWAIVQLLKKLAGAGQSILCTIHQPSATLFEEFDRLLLLRKGGQTVYFGDIGEHSSTLLSYFERNGARRCEEKENPAEYILEAIGAGATASVKEDWHEKWIKSSEFVSVNQEINDLIEKLAHQPNDDSSTELITKYATPYWYQFVYVLRRTMVMFWRDVDYLMAKTMLYISSGLFIGFTFYNVGTSFVGLQNAMFAAFMACIVSAPAMNQIQARALQSRELYEVRESRSNMFHWSCMLFSQYITELPYQLWCSTLFFVSFYFPLKAEYTSLKAGLFYLNYCVIFQLYCVGLGLAVLYMSPDLPSSNVIMGLLLSFMITFCGVVQPVNLMPGFWTFMWKVSPYTYLIQNFVSLMLHDKTVICTDKELSYFNPPPGSTCGSYMTDYFTEGFGYIKNPEATSNCAYCRYKIGDQYLSYISAKYADLWRNFGFLWVYICFNLIAMVSLYYIFHVKRFSPKSLVMGVVGKFKKEK

SEQ ID NO: 199 - DNA, 4596 bp, Saccharomyces castelli
atgtcatttagtacagactctacttcaaccagggatgaacttcccttggttgaaaataattctttagatcacccctacatggggttcgataagacagcacaagaccagatcagagatttggcaagaacactaactcagctaagtgttgctcatccatcagaaagcgccatcgaccaggggtctgatgtacagtcgatatactcaacgggacttcctggaattaatccggtctatacaaatccagatactcctggctatgacgagaaattggatccagcaagtgataatttctcaagtacagcatgggtgaaaaatatggctaacattgccaaatctgatccagatttttataaaccttattccttaggttgtgtttggaaaaatctatcagcttctggtgattctgccgatgtctcttatcaagctactatccttaatatgccatggaagattataacttacgtttataggaaagtgacaccaacaagagaaatagatactttccaaattttaaaatctatggatggaattttaaacccaggtgaattattagtcgtgctgggtagacctggttctggttgtactacattgttaaaatcaatatcttctaatacacatggattcgatattagtaaggactcgatcatttcttataatgggttaactccaaaggatattaggagacattaccgtggtgaagtggtttataatgcagagtccgatattcatttacctcatttaaccgtttatcaaactttattaactgtggcaaggttaaagactcccagtaatagaattaaagacgtcacccgagaagattacgcaaaccaccttactcaagtaacaatggccacatatgggttgttgcatactagggatacaaaagttggtgatgatctcgttaaaggtgtctctggtggtgaacgtaaacgtgtctccattgctgaagtgtccatttgcggatccaaagttcaatgttgggataacgctacgagaggtttggattctgctacagctttggaatttattcgtgctttgaaaacacaggccactattttaaatactactgccacggtagcaatctatcaatgttctcaggatacttacgatctttttgataaagtttgtgtcttagatgatgggtatcaattatattatgggcccagcgacagggctaagaaatatttccaagatatggggtacgtgtgcccaccaagacaaaccacggctgatttcttaacatcagtaacatctccaacagaaagaatattaaaccaagatatgttaaagaatggtaaaaaaattccacaaactccaagggagatgggcgaatattggttagaatctccagattatcaacaattaatgcaacaaattgacgcagaattatcatcaaaccaagatgaacagcgtgatgtcatcagagaagcccatattgccaaacaatctaagagagcaagaccctcttcaccttatgtcgtcagttatatgatgcaagtgaaataccttttaattagaaattattggagaataaaacaaagagccagtgtcacaatttttcaggtggttggtaattctgtcattgcatttatcctaggttccatgttttataaagttcaaaaaaaagctgattcttctacattttatttccgcggtgccgctatgttttttgctatactgttcaatgcattttcgtcgctattagaaatatttacattatttgaggcaagaccaattactgaaaagcatagaacatattcattatatcatccaagtgcagatgcatttgcttcagttctttcagaagtaccagctaagttggttacttctgtttgctttaacattatctactacttcttagttaatttcaaaagagatgccggaatattcttcttttatttcctgatcagtatcgtatccacttttgcattatcacatttatttagatgtaatggatctctatcaaagaccttaccaggtgctatggttcctgcatccatgttattactcgccatttccatgtatacagggtttgccattcctgagacaaaaatgttaggttggtcaaaatggatttggtatattaatccattggcgtacctttttgaatcattaatgattaatgaattccatgatagaagatttccctgtgctcaattcattcctgcaggtccaccataccaaaatgcaacaggtactgagagagtttgtgctgctgttggatctgttcccggtcaagattttgttaatggggatattttcttattagaaagttatggttatcaacacaagcataaatggcgtggatttggtgttggtatggcatttgtggtattcttcttctttggttacttaattctttgtgaatataatgaaggtgccaaacaaagaggtgaaatgctaatcttccctcagaatatcgtgagaaagatgaaaaagcaaggcaagctaaagggaaaacatcctaataaagatgatattgaagcggcagcaagttctatggaatgcaatactactgaaaagagtatattaaattcttcatctataaattatgatgacatggaatccgaagtgggtctttcaaaatcagaggctattttccattggagaaatttatgttatgaaatcccaatcaagaaagaaataaggcatatcttaaataacatcgacggttgggtaaagccaggcactcttactgcattaatgggggcgtctggtgctggtaagactactctattagattgtttagctcagagagttaccgtgggtacaataactggtgatgtttttgttaatggctgcttgcgtgacgaatcgttcccaagatcaattggatattgtcaacaacaagatctacatttgaaaacttcaacagtgagagaatccttaagattttctgcttatctacgtcaaccattcgatgttcctgttgaagagaaaaataaatatgtagaagaaattattaaaactttggagatggaaacttacgctgatgctgttgttggtgtcccaggtgaagggttgaacgttgagcaaagaaagaggttaactatcggtgtggaattggctgctaaaccgaaattattggttttcctcgatgaacctacatctggtttagattcgcaaactgcttgggcaacatgtcaattaatgaaaaaattagcacaaaatggacaagcaatcctctgtaccattcaccaaccttctgctatattaatgcaaaattttgatcggttattatttcttcaaaaaggtggtgagactgtttattttggtgatttgggtagtggttgtcaaactatgattgattattttgaaaaggaaggtgctgaaaaatgcccacccgaggccaatccagcagagtggatgttgcaaatcattggtgctgcccctggttcccatgccataaaagattttcataaggcttggagaaactcggaagaatataaggctgtgcaaaaagaattggattggatggagcaagagttacctaggagagcaagcgaaaccacaccagaagaacataaacgatttgctactagtgtatggtatcaattcaaattagtcagtgtacgtttattccagcaatattggagatctcctgaatatctttggtcaaaatatcttttaactgtcttcaacgaaacctttattggttttaccttttttaaagcagataggactatgcaaggcctacaaaaccaaatgttggccacctttatgttcactgttgtttttaatccactattagaacaatatttacctggttttgttgaacaaagaggtttatatgaggcaagggaacgtccatcaagaacattttcttggatagcttttattctttcccaaattgttgttgaaattccatggaactttgtagcaggtaccattgcttattttatttattactatgcaattggtttttacatgaatgcctccgctgctggtcagttacatgaaagaggtgcattatactggttattatgtactgcgttctttgtttatattggttctatggctgtagctgttatttccttcatcgaaattgctgatactgcgggtcagttggcttcattattatttacaatggctttatccttctgtggtgtcatggttactccttctgcgttgcccagattctggatctttatgtatagaatttctcctttaacatatttgattgatgcatttttgtctgttggtattgctaatgttgatgtggaatgcgcctcatttgaatttgttcaatttagtcctccaccgggtatggattgtgggacatatatggcaccgtatattcaaatgacggggactggatatttatctgattcatctgcgacagatacatgtcatttttgccaattttcgcacaccaatgattttttgaaatcggttggctcagattattcaaagagatggagaaattggggtatttttatttgttacattgccataaattacattgctgctgtttcattctactatctcgcaagagttccaaagtctactggtgaaataaaagaacagaatcagaagacaagggaaggggagaatttaacaggaagttctgaagatcaacaaaaagtttctgcttag

SEQ ID NO: 200 - protein, 1531 aa, Saccharomyces castelli
MSFSTDSTSTRDELPLVENNSLDHPYMGFDKTAQDQIRDLARTLTQLSVAHPSESAIDQGSDVQSIYSTGLPGINPVYTNPDTPGYDEKLDPASDNFSSTAWVKNMANIAKSDPDFYKPYSLGCVWKNLSASGDSADVSYQATILNMPWKIITYVYRKVTPTREIDTFQILKSMDGILNPGELLVVLGRPGSGCTTLLKSISSNTHGFDISKDSIISYNGLTPKDIRRHYRGEVVYNAESDIHLPHLTVYQTLLTVARLKTPSNRIKDVTREDYANHLTQVTMATYGLLHTRDTKVGDDLVKGVSGGERKRVSIAEVSICGSKVQCWDNATRGLDSATALEFIRALKTQATILNTTATVAIYQCSQDTYDLFDKVCVLDDGYQLYYGPSDRAKKYFQDMGYVCPPRQTTADFLTSVTSPTERILNQDMLKNGKKIPQTPREMGEYWLESPDYQQLMQQIDAELSSNQDEQRDVIREAHIAKQSKRARPSSPYVVSYMMQVKYLLIRNYWRIKQRASVTIFQVVGNSVIAFILGSMFYKVQKKADSSTFYFRGAAMFFAILFNAFSSLLEIFTLFEARPITEKHRTYSLYHPSADAFASVLSEVPAKLVTSVCFNIIYYFLVNFKRDAGIFFFYFLISIVSTFALSHLFRCNGSLSKTLPGAMVPASMLLLAISMYTGFAIPETKMLGWSKWIWYINPLAYLFESLMINEFHDRRFPCAQFIPAGPPYQNATGTERVCAAVGSVPGQDFVNGDIFLLESYGYQHKHKWRGFGVGMAFVVFFFFGYLILCEYNEGAKQRGEMLIFPQNIVRKMKKQGKLKGKHPNKDDIEAAASSMECNTTEKSILNSSSINYDDMESEVGLSKSEAIFHWRNLCYEIPIKKEIRHILNNIDGWVKPGTLTALMGASGAGKTTLLDCLAQRVTVGTITGDVFVNGCLRDESFPRSIGYCQQQDLHLKTSTVRESLRFSAYLRQPFDVPVEEKNKYVEEIIKTLEMETYADAVVGVPGEGLNVEQRKRLTIGVELAAKPKLLVFLDEPTSGLDSQTAWATCQLMKKLAQNGQAILCTIHQPSAILMQNFDRLLFLQKGGETVYFGDLGSGCQTMIDYFEKEGAEKCPPEANPAEWMLQIIGAAPGSHAIKDFHKAWRNSEEYKAVQKELDWMEQELPRRASETTPEEHKRFATSVWYQFKLVSVRLFQQYWRSPEYLWSKYLLTVFNETFIGFTFFKADRTMQGLQNQMLATFMFTVVFNPLLEQYLPGFVEQRGLYEARERPSRTFSWIAFILSQIVVEIPWNFVAGTIAYFIYYYAIGFYMNASAAGQLHERGALYWLLCTAFFVYIGSMAVAVISFIEIADTAGQLASLLFTMALSFCGVMVTPSALPRFWIFMYRISPLTYLIDAFLSVGIANVDVECASFEFVQFSPPPGMDCGTYMAPYIQMTGTGYLSDSSATDTCHFCQFSHTNDFLKSVGSDYSKRWRNWGIFICYIAINYIAAVSFYYLARVPKSTGEIKEQNQKTREGENLTGSSEDQQKVSA

SEQ ID NO: 201 - DNA, 4197 bp, Candida glabrata
atgtctttggcagattatttcacaccggtgcctaacgcatcggtgacattcgaaggaactaccgtgaatttgaatgaaaccgctactggttccgctcattcccacgctgaggacccagagttcggagaaaaattgccgctaccttcagtgtccccttgcgaaaatggccaagtggtagacctgactttccaagccactgcaggtgaaatggtgctagtgctcggtgccccaacgtcgggtatcttcaagtccctgtttcacgcccacaagcacctgagttattcccctcagggttccatcaggttcaaggacaacgagttcaaggcatactcgtcgaaatccccacaccagatcatttacaataacgaacaagacgtgcacttccctttcttgaccgtcaaccagactgtcgatttcgcactctcgtgtaaattcgatatcccaaaggaagagcgtgaaaacatgcgtaatgaactgttaagagagttcggtctgtcccacgtcggtgacaccattgtcggtaacgactacttccgtggtgtctcaggtggtgaaagaaaacgtatctccattatcgagactttcatcgccaatggttccgtatacctgtgggataactccacaaaaggtctggattcctcaaccgctttggatttcttgaccattctacaaaaaatggcaagaactactcgttccgttaacctggtcagaatctctcaagcttccgacaagatcgtcgagaaattcgataagatcctgatgctttcggactcttaccaagtattctacggtaccgtcgacgaatgtttgcatcatttccgcgataaccttggcatcaagaaggatccaaatgactgtatcatcgaatacttgacttctattttaaattttcaattcagaactaagtctctagacataacaggttcttccgaggacctagatctaaaggatacagaccacaatgaacaaactttctcgggcattgcttcttctctatgctcagaagttgatttatacacccaatggaaaaaatcctcttactaccaagatatcaaggagcaaatcggagccttcaacgtcgaaaacaaagctgatggtaatcacatcaacccagaggatgtcacaaagacatttgacattccattaaagaagcaaattctatactgtactaagagagctttccaaagaagtttgggtgacaaagcctatatgatttctcaagtgatctcggttattatccagtcattggttattggttcgcttttctacgacattccaatgactaccattggttctttctctagaggttctttgacctttttctccattctgttcttcactttcttgtcgctagctgatatgccaattgcttttcaaagacaagctgttgttaagaaacaaacattgctgcatttctactttaacagtgtcgaaactttggcaactacattgtttgattattgtttcaagttctgcttagtggtcattttcaccattattctttacttcttagctcatctgcaatacaatgccgctagattctttatcttcctgctgttcctttctgtctacaatttctgtatggtctcattgttctccctaacaacaatgtttacaccaactatctctttggctaacttgttcgctggtattctattacttgccattgctatgtacgcctcttatgttatttacatgaaggatatgcatccatggtttgtatggattgcctacttgaaccctgcaatgtacgctatggaatcaatcctagccaatgaaatgttcaacttgaaacttgactgtactgaatctgtcgttcctcgtggtcctacttatcaaaatgttcctgtcaccaacaaagcctgtgcttggcaaggtgctactttgggtaatgattatgttagaggtaaggattacttgaagaacggtttgagttataagtacagccatgtctggagaaactttggtatcttgattggtttcctttgtttcttcatagccatgaacttgtttgcttccgaatacatcaagccattgttctacaatgatggtccagaagctgttcaacatttcattaacagatggttccgcagatcagccactcattctactacctcatcttcttctcctgaaaacattaagttgaaggaagatgttgttgttaagtctgcttccctatcttccacctcttctctatcatcctctgaaacagctaagtctaatccatttgctgacaagactgtgcaagcgcaaaagcatgttatctcatggaagaatatcaactacactgttggtggtgataagagactgattaacaatgtctctggttacattggttctggtttgactgccttgatgggtgaatctggtgcaggtaagactactttgttgaacgttttgtctcaaagaacagaatcaggtgtggttagtggtgaaattttgattgatggtaaaccattgaccaacgaaaacgctttcagaagaagtattggttttgtgcaacaacaagatattcatttggaactattgactgttaaggagtcgttggaaatctccagtgaattaagaggtgatggtgatatggaatatgtcgaaagtatttctgaactattgaagttgcctcttgactctcttgtacgtgagttgaacccaactcaaaggaaactgctatctattggtgtcgaattggtcactaaaccatctttgctattgtttttggatgaacctacctctggtttggatgctgaagccgctttgactattgttcagtttttgaaaaaactttctctacaaggtcaagctattttctgtactattcatcaacctagtaagagtgttattagctactttgacaacatctatttgttgaaacgtggtggtgaatgtgtatacttcggcccaactagtgaagcttgtggttactttatgtcttatgataaatctttgacctacgatcctgaaagcgacaatcctgctgattttgttattgatgttgttggtaacaatgaatcaatggaagaaatggatgacaaggctgactttgctatcagagaggaaaacccatggtccacccgttgggaaaactcacatgaaagaaagaatattgatgagactgttgttagacttgaacaagaggctgctgcttcaggcgttgatttcactacagctgtttgggagcaaccttcttacatgaaacaattgattatgattactaagagacaatacacttgtactagaagagatagatcttacattgccgctaaatacttgttaaatggtggtgctggtttgtttatcggtttctctttctggaagatcaaacatactatttccggtcttcaagacactatcttcttctgtttcatggctctttgtgtttcttcaccattgattaaccaagtgcaagataaggctttacaatcaaaggaagtctttattgccagagaatcgagatctaacacctaccactggacctgtctactgctagctcaatttatcattgaactacctctggctatgtccagttcgacattgttctttgtctgtgcattcttctgttgtggtttcgataacagcggtaaagttgctggtgtcttctacttgaactacatcttattcagtgcttattatttaacattgggtctatggttaatttacacagctccaaatcttcaaactgccgctgtgtttgttgcctttatttacagtttcacagcttctttctgtggtgtcatgcaaccttatgctttattcccaggtttctggaagtttatgtacagagtgtcaccatacacttacttcgttgatacttttgtcagtacactgcttcacaaccgtaaggttatctgtaacaccggtgaaatggttccaggtcagccaactggtggtaagacttgtggccaattcttcaaggcttatattgacgaatatggtggatggttgaagaatccaaacactttcactgtttgtgcatactgtacctatgatactggtgatgatttcttaaagcaacaaaatatgtcccatagccacatctggagaaactacggtatcgagtgggctttcgttgcatttaacttcttcgccatgtttgctggttactacttaacctacgttgccaaggtatggccaaaggtttttaagttcatcatgaaattgatcccaactggtatcaagtctagagcatccaaggactaa

SEQ ID NO: 202 - protein, 1398 aa, Candida glabrata
MSLADYFTPVPNASVTFEGTTVNLNETATGSAHSHAEDPEFGEKLPLPSVSPCENGQVVDLTFQATAGEMVLVLGAPTSGIFKSLFHAHKHLSYSPQGSIRFKDNEFKAYSSKSPHQIIYNNEQDVHFPFLTVNQTVDFALSCKFDIPKEERENMRNELLREFGLSHVGDTIVGNDYFRGVSGGERKRISIIETFIANGSVYLWDNSTKGLDSSTALDFLTILQKMARTTRSVNLVRISQASDKIVEKFDKILMLSDSYQVFYGTVDECLHHFRDNLGIKKDPNDCIIEYLTSILNFQFRTKSLDITGSSEDLDLKDTDHNEQTFSGIASSLCSEVDLYTQWKKSSYYQDIKEQIGAFNVENKADGNHINPEDVTKTFDIPLKKQILYCTKRAFQRSLGDKAYMISQVISVIIQSLVIGSLFYDIPMTTIGSFSRGSLTFFSILFFTFLSLADMPIAFQRQAVVKKQTLLHFYFNSVETLATTLFDYCFKFCLVVIFTIILYFLAHLQYNAARFFIFLLFLSVYNFCMVSLFSLTTMFTPTISLANLFAGILLLAIAMYASYVIYMKDMHPWFVWIAYLNPAMYAMESILANEMFNLKLDCTESVVPRGPTYQNVPVTNKACAWQGATLGNDYVRGKDYLKNGLSYKYSHVWRNFGILIGFLCFFIAMNLFASEYIKPLFYNDGPEAVQHFINRWFRRSATHSTTSSSSPENIKLKEDVVVKSASLSSTSSLSSSETAKSNPFADKTVQAQKHVISWKNINYTVGGDKRLINNVSGYIGSGLTALMGESGAGKTTLLNVLSQRTESGVVSGEILIDGKPLTNENAFRRSIGFVQQQDIHLELLTVKESLEISSELRGDGDMEYVESISELLKLPLDSLVRELNPTQRKLLSIGVELVTKPSLLLFLDEPTSGLDAEAALTIVQFLKKLSLQGQAIFCTIHQPSKSVISYFDNIYLLKRGGECVYFGPTSEACGYFMSYDKSLTYDPESDNPADFVIDVVGNNESMEEMDDKADFAIREENPWSTRWENSHERKNIDETVVRLEQEAAASGVDFTTAVWEQPSYMKQLIMITKRQYTCTRRDRSYIAAKYLLNGGAGLFIGFSFWKIKHTISGLQDTIFFCFMALCVSSPLINQVQDKALQSKEVFIARESRSNTYHWTCLLLAQFIIELPLAMSSSTLFFVCAFFCCGFDNSGKVAGVFYLNYILFSAYYLTLGLWLIYTAPNLQTAAVFVAFIYSFTASFCGVMQPYALFPGFWKFMYRVSPYTYFVDTFVSTLLHNRKVICNTGEMVPGQPTGGKTCGQFFKAYIDEYGGWLKNPNTFTVCAYCTYDTGDDFLKQQNMSHSHIWRNYGIEWAFVAFNFFAMFAGYYLTYVAKVWPKVFKFIMKLIPTGIKSRASKD

SEQ ID NO: 203 - DNA, 4590 bp, Saccharomyces cerevisiae
atgtcatcagatatcagagacgtagaggaacgaaattcgcggagctcgagctcaagctcgagctcgaactctgccgcccaatccattggacagcatccataccgcggtttcgacagcgaagccgcggaaagggtgcatgagttggctagaacactcacatcgcagagtttactatacactgctaactcaaacaatagctcttccagcaaccataatgcgcacaatgcggactcgagatccgtattttctacggacatggaaggtgtgaacccggtgttcactaacccggacaccccgggatacaatcccaaattggaccctaacagtgatcaattctccagtacggcgtgggtacagaacatggcaaatatttgtacttcggacccggatttctataaaccatactcactcggttgtgtatggaagaatctaagcgcctccggagactccgccgatgtgtcataccagtcaactttcgctaacatcgtaccaaagctgcttacgaaagggctcagattactgaagcccagtaaagaagaggacacttttcagatcctgaaacccatggatggttgtcttaatcccggtgaactgttggttgttcttgggagaccagggtcaggttgtactacgctgctaaaatccatatcttctaattcgcacgggttcaagatcgcaaaagactccattgtctcttacaacggtttgtcaagctcggatatcaggaaacattaccgtggtgaagtcgtttacaatgcggaatcagatattcatttaccgcatcttaccgtgtaccagacgcttttcaccgtggcaaggatgaaaacgccgcaaaatcgtatcaagggtgttgatagagaagcgtacgccaatcacgtgacagaagttgcaatggccacatatggtctttcgcatacaagggacaccaaggtcggaaacgatctagtcagaggtgtttctggtggtgaaagaaagcgtgtatccattgcggaagtcgcaatctgcggcgccagatttcaatgttgggataatgccaccagaggtttggactctgctactgctttagaattcatccgtgctttaaaaacccaggctgacattggaaagaccgcggctactgtggccatctatcaatgttctcaggatgcttatgatctttttgataaggtctgtgtcctggatgatggttaccagctttattttgggcccgctaaggatgcaaagaaatatttccaagacatgggctactattgtcctcccagacagaccactgcagattttttaacttcaattacaagtcctactgaaagaattattagcaaagaatttatcgaaaaaggtactagagtgcctcaaacgccaaaggatatggccgaatattggctacaatcagaaagctacaaaaatttaatcaaggatatagactctacattagagaaaaacacagatgaagcacgcaatattatcagggatgctcaccacgctaaacaggcaaaaagggcaccaccttcctctccatacgttgtcaactacggaatgcaagtcaaatacttgttgattagaaatttctggagaatgaagcaaagtgctagtgttactttgtggcaagtcatcggtaactctgtcatggctttcatcttgggttctatgttttataaagtgatgaagaaaaacgatacttccactttctatttccgtggtgctgcaatgttttttgctattttatttaatgcattttcgtgtcttttggaaatctttagtttgtatgaaacaagacctataactgaaaaacacagaacttattccttgtatcatccaagcgctgacgcatttgcgtctgttttgtcagaaatgccgccaaaattgatcactgctgtctgcttcaacatcatcttttatttcctagttgatttcaggagaaacggtggtgtctttttcttttattttttaattaatgtcattgccacattcactttatcccatttatttagatgcgtgggctccttgaccaaaacattacaggaggccatggtccccgcttcaatgttattattggcaatttctatgtatacagggtttgccatccctaaaacgaagattttaggttggtccatttggatttggtatatcaacccgctagcctacctgtttgaatctttaatgatcaatgaattccatgaccgtagattcccttgtgcccaatacatccctgctggccctgcttatcagaacatcacaggtactcaacgcgtctgttccgcagttggtgcttatccaggtaacgactatgtgttgggtgatgacttcttgaaggaaagttacgattatgagcacaaacataagtggcgtgggttcggtattggtatggcatatgttgttttctttttctttgtttatctaattctttgtgagtataatgaaggtgctaaacaaaagggtgaaatggttgtgttcctaagatctaagatcaagcaattgaaaaaggaaggtaaattacaagaaaagcataggcctggagatattgaaaataatgcaggcagttctccagattccgctacaacagaaaaaaaaatactagatgatagttctgagggatcggatagctcttcagataatgccggattaggactttccaaatctgaagcaattttccactggcgtgatttatgctatgatgttcctataaaaggaggtcaaagacgtatcttaaataacgtagatggttgggtaaaaccaggcactttgactgccttaatgggggcgtcaggtgcaggtaaaacaactttactggattgtttggctgaaagagtcaccatgggtgttattactggtaatatttttgtcgatggtcgtctccgtgacgaatcattccctagatctattggttattgtcaacaacaggatttacatttgaaaacggctacagtaagagaatctttgagattttcagcttatttacgtcagccttcgtcagtttctattgaagaaaaaaataggtacgtggaagaagttatcaaaattttggaaatgcaacaatattcagatgctgttgttggtgttgcaggtgaaggtctaaatgtcgaacaaagaaaaagacttactattggtgttgaactagcggcaaggcctaaacttttggtttttttggatgaaccaacttcaggcctggattcacaaactgcttgggacacttgccaacttatgaggaaactagctacccacggtcaagcaattttgtgtactatccatcaaccttctgctatattaatgcagcagtttgatagattattatttttacagaaagggggccaaactgtatatttcggcgatttaggtgaagggtgcaaaactatgatcgattattttgaaagtaaaggagctcacaaatgtccacctgatgcaaaccctgccgaatggatgttagaggttgtaggtgccgctcctggttctcacgctacgcaagattataatgaagtctggagaaactcagatgaatacaaagctgttcaggaagaattggattggatggaaaagaatttaccaggcaggtcaaaagaaccaactgcagaagaacataaaccttttgctgcatctttatactaccaatttaaaatggttaccattcgtttgttccaacaatactggagatcaccagattatttatggtcgaaatttattttgactattttcaaccaagtttttattgggttcacttttttcaaggctgacagaagtttacagggactacaaaaccaaatgttatcaatattcatgtatacggttattttcaatcctatactacaacagtatctaccatctttcgtgcagcaaagggatttgtatgaggcaagagaacgtccttcaagaacattttcgtggcttgcgtttttcctctctcaaatcattgttgaaatcccatggaatattttagcgggtacgattgcttattgtatttactattacgcggttggattttatgcgaacgcctcagctgctggtcaactccatgagagaggtgctttgttttggttattttctattgccttctacgtctacattggttcgatgggtttgttaatgatttctttcaatgaagttgctgaaacagcggcacatatgggaacgctattgttcacgatggcattatctttctgtggtgttatggctacccctaaggttatgccaagattttggatctttatgtatagagtgtcacccctaacttatatgatcgatgcattattagcccttggtgtggctaatgtggacgttaagtgttcaaattatgaaatggtaaaatttactccaccatctggaaccacctgcggtgactatatggcatcatatatcaagttggccggaacaggctacttgagtgacccgtctgcaacagatatatgtagtttctgtgcggtatccaccaccaatgcctttttggccactttcagttctcattattacagaagatggagaaattacggtatttttatctgctatattgcttttgattatatcgctgcaacattcttgtattggttatccagggtacccaagaagaacggtaagatttccgaaaaacccaagaagtga

SEQ ID NO: 204 - protein, 1529 aa, Saccharomyces cerevisiae
MSSDIRDVEERNSRSSSSSSSSNSAAQSIGQHPYRGFDSEAAERVHELARTLTSQSLLYTANSNNSSSSNHNAHNADSRSVFSTDMEGVNPVFTNPDTPGYNPKLDPNSDQFSSTAWVQNMANICTSDPDFYKPYSLGCVWKNLSASGDSADVSYQSTFANIVPKLLTKGLRLLKPSKEEDTFQILKPMDGCLNPGELLVVLGRPGSGCTTLLKSISSNSHGFKIAKDSIVSYNGLSSSDIRKHYRGEVVYNAESDIHLPHLTVYQTLFTVARMKTPQNRIKGVDREAYANHVTEVAMATYGLSHTRDTKVGNDLVRGVSGGERKRVSIAEVAICGARFQCWDNATRGLDSATALEFIRALKTQADIGKTAATVAIYQCSQDAYDLFDKVCVLDDGYQLYFGPAKDAKKYFQDMGYYCPPRQTTADFLTSITSPTERIISKEFIEKGTRVPQTPKDMAEYWLQSESYKNLIKDIDSTLEKNTDEARNIIRDAHHAKQAKRAPPSSPYVVNYGMQVKYLLIRNFWRMKQSASVTLWQVIGNSVMAFILGSMFYKVMKKNDTSTFYFRGAAMFFAILFNAFSCLLEIFSLYETRPITEKHRTYSLYHPSADAFASVLSEMPPKLITAVCFNIIFYFLVDFRRNGGVFFFYFLINVIATFTLSHLFRCVGSLTKTLQEAMVPASMLLLAISMYTGFAIPKTKILGWSIWIWYINPLAYLFESLMINEFHDRRFPCAQYIPAGPAYQNITGTQRVCSAVGAYPGNDYVLGDDFLKESYDYEHKHKWRGFGIGMAYVVFFFFVYLILCEYNEGAKQKGEMVVFLRSKIKQLKKEGKLQEKHRPGDIENNAGSSPDSATTEKKILDDSSEGSDSSSDNAGLGLSKSEAIFHWRDLCYDVPIKGGQRRILNNVDGWVKPGTLTALMGASGAGKTTLLDCLAERVTMGVITGNIFVDGRLRDESFPRSIGYCQQQDLHLKTATVRESLRFSAYLRQPSSVSIEEKNRYVEEVIKILEMQQYSDAVVGVAGEGLNVEQRKRLTIGVELAARPKLLVFLDEPTSGLDSQTAWDTCQLMRKLATHGQAILCTIHQPSAILMQQFDRLLFLQKGGQTVYFGDLGEGCKTMIDYFESKGAHKCPPDANPAEWMLEVVGAAPGSHATQDYNEVWRNSDEYKAVQEELDWMEKNLPGRSKEPTAEEHKPFAASLYYQFKMVTIRLFQQYWRSPDYLWSKFILTIFNQVFIGFTFFKADRSLQGLQNQMLSIFMYTVIFNPILQQYLPSFVQQRDLYEARERPSRTFSWLAFFLSQIIVEIPWNILAGTIAYCIYYYAVGFYANASAAGQLHERGALFWLFSIAFYVYIGSMGLLMISFNEVAETAAHMGTLLFTMALSFCGVMATPKVMPRFWIFMYRVSPLTYMIDALLALGVANVDVKCSNYEMVKFTPPSGTTCGDYMASYIKLAGTGYLSDPSATDICSFCAVSTTNAFLATFSSHYYRRWRNYGIFICYIAFDYIAATFLYWLSRVPKKNGKISEKPKK

SEQ ID NO: 205 - DNA, 4530 bp, Saccharomyces kluyveri
atgtcgtcggatgatgaagaacaccaaaagaaggaggactctcgctctttacagtctacggactcctatgcccagtccatccactctttcaacgctgtagatgatgaagcacagaatgccacttctcaactttctcgccacatcacaacaattctatctcaggaccagggtgttgaccgtatcgagtctcttgcaagggtcttgtccaccaagaccaagcgcgagatggacagcttcgaagtcaactctttggactttgaccttcgcgagttactaaactacttgagaaaccaccaactgtcccagggtatcgaacccggtgattcgggtgttgcatttcgcagcttgaccgccatcggtatcgacgcttctgccgcttacggtccaagtgtcgaagagatggtccgttcctgggtcgatttccccaaacgccttgctcacaagatcatgcgcaagaaagatgaagttcccttgagaaacgtcattcaaaactgtaccggtgtcgtcgaaagcggtgaaatgctgttcgttgtcggtagaccgggggccggttgctcgactttgctaaagtgtgtttccggtgaaatctcagaactggttgaggttcaaggtgacttttcctacgacggtctggaccaagaagagatgatgtcaaagttcaagggctatgtcatctactgtcccgaactggatttccatttcccaagaatcaccgtcaaggagaccattgattttgccctaaaatgtaagacgcctcgtgtcagaatcgacaagatgaccagaaatcaatacgtcgactccatgagagatctatggtgtaccgtctttggtttgagacacacgtacgccacaaaagtcggtaacgattttgtgagaggtgtctctggtggtgaacgtaagcgtgtttccctggtcgaagccctggccatgaacgcctccatttactcgtgggataacgccacaagaggtttggatgcgtccaccgctttggaatttgcccaggccatcagaacagccaccaacatgatgaacaactctgcggtcgtggccatctaccaggccggtgaaaacatctaccagctgtttgacaaagccaccgtcttgtacagcggtagacaaatctactttggtccagccaccgaggcggttgggtattttgaaaacatgggctggatcaagccctccagaatgacctctgccgagtttttgacctctgtcacagtcgattttgaaaacagaactttggacatcaaaccggggtacgaagagaaaatccccaagtcctctgtagagtttgaaaactactggctaaactcttccgaataccaacaggttttggcccagtacgacgactactgcaacaggcaccctgcagaagacaccagggacagattggaaagagccaagtctcaaagattgcagcgcggtcaaagagccaagtctcagttcgtcgtcaacttctggtcccaggtttggtactgtatgataagaggtttccagagaaccaaaggtgatatgacttatacaaaggtctacctatcctctttcttgatcaaaggtttgattgtcggttccatgttccacaaaatcgatccgaaaagccagtccaccacagaaggtgcatactcccgtggtggtttgttattctacgtgctgttgttttgtgctttgacttctttggctgaaatctcccactcttttgcgaacagaccaatcatcgtgaaacacaaatcctactccatgtaccacacctctgccgaagccctgcaagagattttcaccgaaatcccaacaaagcttactgccgtcctatgtttgtcccttgtcagttattggatcccatacttgaaatgggatgctggttccttcttccaatacttgttatacctgttcaccacacagcagtgtacatcctttatcttcaaactggttgccaccttgaccaaagacggtggtactgcgcacgccctgggtggtctgtgggtcttgatgcttacggtctatgccggttttgtcttgcctatcggtgaaatgcatcactggattagatggttccattacttgaaccccttgacatacgcctacgagagtttggtctccaccgagttccacggcagacgtatgctgtgtagcaatttggttcctagcggcccaggttacgaatccgtttctctagtgaatcaagtctgtgatgcgttgggtgctgttaagggctctgcttatgtcgatggtgacgtctttattttgaaaaaataccacttcagctacgaccatgcctggagagactggggtatcaacattgtctggacctttggttacattgtgatgaacgttatcatgtccgaatacctgaagccgcttgaaggcggtggtgatctgttgttgtacaagagaggccacatgcctgagctcggttctgaatctgccgatgctaaggttgcttcaagagaagagatgatggagtccctaaacggccccggtgtcgatttggaaaaagtcattgcagaaaaggacgtctttacttggaaccatctggactacactatcccatacgacggtagcacaagacagctgttgagcgatgtgtttggctatgtcaagcccggtaagatgaccgctttgatgggtgagtccggtgcaggtaagaccacgttgctaaacgtcttggctcaaagaatcaacatgggtgtcattactggtgatatgtttgtcaacgccaaacctttgccagactccttcaacagatcctgtggttacgtggcacaggcagacaaccatatggctgagttgtcggtcagggaatccctgaggtttgctgccgagttgagacagccaaaatctgttcctctggaagaaaaatacgagtatgtggaaaagatcatttccctgttgggtatgcaaaactacgccgaggccatcgttggtaagaccggtagaggcttgaacgttgagcagagaaagaaactgtccattggtgtcgaactggttgccaaaccttccctactgttgtttttggatgagccaacctctggtttggattctcaatctgcctggtccattgttcagtttatgagagctttggccgactccggtcagtccattctttgtaccatccatcaaccttctgccactctgtttgagcagtttgacagactgttgttgttgaaaaagggtggtaagatggtctactttggtgacattggtgaaaactcccaagctttgttgtcctactttgagcgccaatctggtgtcaagtgtggcgagtctgaaaatcctgccgagtacatcttgaactgtatcggtgctggtgccaccgcttctgctgacgccgactggcacgacctgtggttggcttctcccgagtgtcaagccgccagagatgaggttgaagagctgcaccgggttttgccaagcaagccggttaaagacgacaaggaactggccggcaggtttgccgcttcctacctgacccagatgaagtgtgtgatgcggagaacctttatccagttctggagatcgcccgtctacatcagggccaagtttttggaatgtatcatctgtgctcttttcgtcggtttgtcctacgtcggtgtcaaccactctgttggtggtgccaccgaagccttctcgtccatctttatgatgttgttgattgccctggccatgatcaaccagctgcacgtctttgcatacgactccagagagttgtacgaggttagagaagctgcttccaacactttccactggagtgctttgctgctatgccacacttttgtcgagatcttctggtccaccatctgcgaattcttttgttacatctgctactactggccggctcagtacagcggcagagcgtcccatgctggttatttcttcttgatctatgtcttgatcttcccaatatattttgtcagctatggttgttggatcctgtacctgtccccagacgtgccatctgcctccatgatcaattccaacctgtttgcagccatgttgttgttctgtggtatcctgcagcctagagaaaagatgccaggtttctggaagagattcatgtacaatgtgtcacccttcacatacgtggtacaagctttggttgcgccattggttcacaacaagtctgtaaagtgtgagccacacgagctgaacgtcatggacccacccagcggccagaattgtggtgactttttgaagacctacatcgccaacaataccggctacttgctcaacccagatgccactgccaactgtgagtactgtccatacactgttcaggaccaggttgttgagcagttcaacgtcaagtggagctacaggtggaggaactttgggttcttgtgggcttacatctgtttcaactttggtgccatgctggtttgttattacgtcatgagagtcaaggtttggtcgttaaagtctattttggactttaagaagtggttcaacggacccaggaaggaaagacacgaaaaggatacaactattttccaaactcaacccggagatgaagctaaggtcaaaaagaactaa

SEQ ID NO: 206 - protein, 1509 aa, Saccharomyces kluyveri
MSSDDEEHQKKEDSRSLQSTDSYAQSIHSFNAVDDEAQNATSQLSRHITTILSQDQGVDRIESLARVLSTKTKREMDSFEVNSLDFDLRELLNYLRNHQLSQGIEPGDSGVAFRSLTAIGIDASAAYGPSVEEMVRSWVDFPKRLAHKIMRKKDEVPLRNVIQNCTGVVESGEMLFVVGRPGAGCSTLLKCVSGEISELVEVQGDFSYDGLDQEEMMSKFKGYVIYCPELDFHFPRITVKETIDFALKCKTPRVRIDKMTRNQYVDSMRDLWCTVFGLRHTYATKVGNDFVRGVSGGERKRVSLVEALAMNASIYSWDNATRGLDASTALEFAQAIRTATNMMNNSAVVAIYQAGENIYQLFDKATVLYSGRQIYFGPATEAVGYFENMGWIKPSRMTSAEFLTSVTVDFENRTLDIKPGYEEKIPKSSVEFENYWLNSSEYQQVLAQYDDYCNRHPAEDTRDRLERAKSQRLQRGQRAKSQFVVNFWSQVWYCMIRGFQRTKGDMTYTKVYLSSFLIKGLIVGSMFHKIDPKSQSTTEGAYSRGGLLFYVLLFCALTSLAEISHSFANRPIIVKHKSYSMYHTSAEALQEIFTEIPTKLTAVLCLSLVSYWIPYLKWDAGSFFQYLLYLFTTQQCTSFIFKLVATLTKDGGTAHALGGLWVLMLTVYAGFVLPIGEMHHWIRWFHYLNPLTYAYESLVSTEFHGRRMLCSNLVPSGPGYESVSLVNQVCDALGAVKGSAYVDGDVFILKKYHFSYDHAWRDWGINIVWTFGYIVMNVIMSEYLKPLEGGGDLLLYKRGHMPELGSESADAKVASREEMMESLNGPGVDLEKVIAEKDVFTWNHLDYTIPYDGSTRQLLSDVFGYVKPGKMTALMGESGAGKTTLLNVLAQRINMGVITGDMFVNAKPLPDSFNRSCGYVAQADNHMAELSVRESLRFAAELRQPKSVPLEEKYEYVEKIISLLGMQNYAEAIVGKTGRGLNVEQRKKLSIGVELVAKPSLLLFLDEPTSGLDSQSAWSIVQFMRALADSGQSILCTIHQPSATLFEQFDRLLLLKKGGKMVYFGDIGENSQALLSYFERQSGVKCGESENPAEYILNCIGAGATASADADWHDLWLASPECQAARDEVEELHRVLPSKPVKDDKELAGRFAASYLTQMKCVMRRTFIQFWRSPVYIRAKFLECIICALFVGLSYVGVNHSVGGATEAFSSIFMMLLIALAMINQLHVFAYDSRELYEVREAASNTFHWSALLLCHTFVEIFWSTICEFFCYICYYWPAQYSGRASHAGYFFLIYVLIFPIYFVSYGCWILYLSPDVPSASMINSNLFAAMLLFCGILQPREKMPGFWKRFMYNVSPFTYVVQALVAPLVHNKSVKCEPHELNVMDPPSGQNCGDFLKTYIANNTGYLLNPDATANCEYCPYTVQDQVVEQFNVKWSYRWRNFGFLWAYICFNFGAMLVCYYVMRVKVWSLKSILDFKKWFNGPRKERHEKDTTIFQTQPGDEAKVKKN

SEQ ID NO: 207 - DNA, 4344 bp, Saccharomyces kluyveri
atgtctttcctattaccgcgtcttcaacaaggctctcaggatgactataatcacgctgacgaggcaaacggtgaaaaaatccacgcatccgaaagcagtagcgatacttcccggtccgagaagcaggatcaaaacctttactctgaatacgcctcaatcttgggtaagcgcttacaggatgcccgagccaacggcgtaaagtttagaaattgtggtgtcactggtgaaaatgtcaccataaaaggttttgactctagcttccaattccaaagcacagtacaagatattgtcttttttcctttaacaatatatagggccgtccaggctaagaagcatcatcataaaagaaaaattctatcccagatcaattttttgatcaaacctggtgaaatgtgccttgttttaggaagacccggagccgggtgttcatctttcctaagaactgttgccggtgaactaggaaattttacagacgttgatggtgagatcagctacgatggcataccacagaaggagatgattaaacatttcaaaggtgacatcatatataatggagaaatggacgtccatttccctcatttgactgtctctcaaaccctcgaaatggctatagcttgtaaagagcctcactcgttaagcgatgagaagatccctaagaaacagcatattcacggcaacagagatttatatgctggtatttttcacttgacccataccttcaacaccaaagttggaaatgattttgtcagaggtgtctctggcggggaaaggaaacgtgtttccatagcggaggctatggccgccaggggttctgtttactgctgggacaactcttcgagaggtttggatagtagctcggcctatgactatataaaagccatcagaacagtttctgatttgatcaaatctgtagccttcgtggccatttaccaagctggtgaaaacatttacaggaagtttgacaaggtgactgtgttgtacgatgggagacaaatttattacggcaccatcaacaaagctaaaccatattttgagaggatgggattccagtcttctccaaggcagactactcccgaatttttaactgcaataactcaaagaatcgactctgaggattccacagctgtgaagattagagaagagtttaagaacactattccgagaaccgctgaagattttgaaagggtctggcgtggatcgccggagtaccaagagttgattcaagagattcacgcctacaacaaccgagttgatagtgaggggacaagggctctctatagagattcgatcacccaacagaagtctaagcggagtcgtggtacttctcgctacactataagctatttagagcaaattaaactctgtacgaaaagaggtttccagagaatcagtggtgatagcacatcaactgtaattaacattgctgctgcaaccatccaatcgttgattataggctctctatactataatttaaatccctctacggattctgcatttagtagaagtggtgttctatatttttcgttgctctactactcccttatgggcttggctaacatcggggtatcgcatagattgattgtttcaaagcataaatcttactcactttatcacccctctgctgaaactttggccacatacatttctagtttcccctttagattgattgggttaacagtgttcttcatcataatttactttatgtccaatatgaataggcagccaggaaaattttttttaaactacctattcttagcgctgggtgctgaaactattaacgctttatttcaaatgatcaccgcttttaccgctaacttggcccaaactaacgccctcaacggtttgtttctattggccatgagtatgtattccacctacatgattcaattggaatctatgcacccatggtttaaatggatcaactatttgtcccccttgaggtggatgttggaaaatatgctagccgttgagtttcatggtaggagaatggaatgtaccaatttagttccaagtggtcctggttacgaaactgtgacagaggagaatcaggtttgtgcttttatcggttctgtaccggggcagccatgggtgagcggagacagatatatcaggatccagtatgatttcaggtacagctacatttggaggaattttggtatttgtcttggatttctttgtttctatgttgccttgaatacatttgcagatgagtttagaaaaaaaagcggtagtaaaggtgacagtttgattttcaagagggatgcaaaggcaccggtcgttgtcgcagctatagatgatgaagaaagcttgaataccaataacaatcctcttattgttacgacaaattcgtccactaaggataacaatgatgatgtatttgatggtttgaaaagcaaaggtgtgtttatgtggaaagatgtggactacgttatcccatacaagggaagcgagaaaaagttattggataaggtttcaggttttgtcaaaccaggattaaccgcattgatgggtgcgagtggtgcaggtaaaaccacgttgttaaacgttttggcccaaagaatggattttggcattgttagctcgggtgagattttggtcgacgccaagcctgtggatagaaaattcaaacggtctgttggatacgttcagcaacaggatatacatacacaagagcttacagtacgtgagtctttgcaattctctgctaggttgcgccgtccagacagcgttccggatgcagaaaagatggagtacgttgaaaaaatcatagtagttttaggaatgcaggactattctgatgcggttgttggagaggccgggtttggcttaaatgtagagcaaagaaagaaactatctattggagttgaattggttgcaaagccgactttattgttatttttggacgaaccaacctcggggttagattctcaatcgtcttgggctatcttacagttgttgagaaggttagccgaagccggtcaagccatattatgcaccatacaccagccttctgctactttgttcgaatcgtttgaccggctcttgttattaaaggacggtggttctgttgtgtactggggcaatattggtgatcactctaaagacgtgacaaattattttaaaaaatatggcgccagagaatgtagcgataccgagaatccagccgaatacatgttagaagtgattggcgccggatcttctgtggcgaaggatgattggggtgaaatctggaagcaatccacggagtaccaagattttgttggagagtatgatgacctctacactaagcttttaaacacaaacaagggagatgaccaggatttggaaaaaaaatttgctgttccatatacaacacagttttactatgtttatcggagaacggttacgcagctttggagggacccggggtacatcgtctctaagatgatgttgatgatcagcgctggattattcattgggtttactttttacgatgttggtacaagcttccgtggtctacagaatgcaatgtttgccgtttttatgtctatcattgttgcagcgcccctgatgaatcagatacaatccagggccattcaagcacgtgaattatttgaagcccgtgaatcaaaatcaaacacgttccactggtcttgcttattgttatctcagtatttgagtgaagttccctttcaaatttttttctccactatttattttgtcgctttctacttccctttaaaggttgatgacagtgccagtagggcaggcgtattttttttgcactattgtatcatgtttcaattgtattttattggatttggactactcgtcctatacatttcgcccgatttaccttcagctgcgatcatcatggggctcagcttatcatttatgattggattttgtggtgttgttcagcctgtgaggttgatgccaggtttttggacatttatgtggaaagtgtctcccttcacatatttcatccaaagttttgtatctttgctgttgcacaacaaaaaagtggaatgtcgtcaaaatgaaacttcttatttcagccctccatctggtatgacttgtggcgagtactcacagcagtttgtggaggcaaatttcgggtacgtcatgaatccagaagacagaagcaactgcgcttattgtacttacaaggtcggagaccaatacatgaatacattgagcttcaagtactcttatttgtggagaaattttggattctattgggtctacattttgtttaaccttgtcggtatgctagttgcttactacatttttcacatctacaacttttcgccttttaccaggttaaaacagcaatttatgcggaccaagaaaaccgaagattag

SEQ ID NO: 208 - protein, 1447 aa, Saccharomyces kluyveri
MSFLLPRLQQGSQDDYNHADEANGEKIHASESSSDTSRSEKQDQNLYSEYASILGKRLQDARANGVKFRNCGVTGENVTIKGFDSSFQFQSTVQDIVFFPLTIYRAVQAKKHHHKRKILSQINFLIKPGEMCLVLGRPGAGCSSFLRTVAGELGNFTDVDGEISYDGIPQKEMIKHFKGDIIYNGEMDVHFPHLTVSQTLEMAIACKEPHSLSDEKIPKKQHIHGNRDLYAGIFHLTHTFNTKVGNDFVRGVSGGERKRVSIAEAMAARGSVYCWDNSSRGLDSSSAYDYIKAIRTVSDLIKSVAFVAIYQAGENIYRKFDKVTVLYDGRQIYYGTINKAKPYFERMGFQSSPRQTTPEFLTAITQRIDSEDSTAVKIREEFKNTIPRTAEDFERVWRGSPEYQELIQEIHAYNNRVDSEGTRALYRDSITQQKSKRSRGTSRYTISYLEQIKLCTKRGFQRISGDSTSTVINIAAATIQSLIIGSLYYNLNPSTDSAFSRSGVLYFSLLYYSLMGLANIGVSHRLIVSKHKSYSLYHPSAETLATYISSFPFRLIGLTVFFIIIYFMSNMNRQPGKFFLNYLFLALGAETINALFQMITAFTANLAQTNALNGLFLLAMSMYSTYMIQLESMHPWFKWINYLSPLRWMLENMLAVEFHGRRMECTNLVPSGPGYETVTEENQVCAFIGSVPGQPWVSGDRYIRIQYDFRYSYIWRNFGICLGFLCFYVALNTFADEFRKKSGSKGDSLIFKRDAKAPVVVAAIDDEESLNTNNNPLIVTTNSSTKDNNDDVFDGLKSKGVFMWKDVDYVIPYKGSEKKLLDKVSGFVKPGLTALMGASGAGKTTLLNVLAQRMDFGIVSSGEILVDAKPVDRKFKRSVGYVQQQDIHTQELTVRESLQFSARLRRPDSVPDAEKMEYVEKIIVVLGMQDYSDAVVGEAGFGLNVEQRKKLSIGVELVAKPTLLLFLDEPTSGLDSQSSWAILQLLRRLAEAGQAILCTIHQPSATLFESFDRLLLLKDGGSVVYWGNIGDHSKDVTNYFKKYGARECSDTENPAEYMLEVIGAGSSVAKDDWGEIWKQSTEYQDFVGEYDDLYTKLLNTNKGDDQDLEKKFAVPYTTQFYYVYRRTVTQLWRDPGYIVSKMMLMISAGLFIGFTFYDVGTSFRGLQNAMFAVFMSIIVAAPLMNQIQSRAIQARELFEARESKSNTFHWSCLLLSQYLSEVPFQIFFSTIYFVAFYFPLKVDDSASRAGVFFLHYCIMFQLYFIGFGLLVLYISPDLPSAAIIMGLSLSFMIGFCGVVQPVRLMPGFWTFMWKVSPFTYFIQSFVSLLLHNKKVECRQNETSYFSPPSGMTCGEYSQQFVEANFGYVMNPEDRSNCAYCTYKVGDQYMNTLSFKYSYLWRNFGFYWVYILFNLVGMLVAYYIFHIYNFSPFTRLKQQFMRTKKTED

SEQ ID NO: 209 - DNA, 1092 bp, Saccharomyces castelli
atggctatttccttatactccacttatatgattcaattgcattccatgcgtccatggttcaaatggatttcatatattcttccaatcagatactgttttgaatcaatgcttaacgccgaatttcatggtagacatatggattgtggtggtactttggttccttctggtcctggatacgaaaatgtatcaaatgataacagagtttgcccatttgctggttctaaacctggtcaatcctgggttctaggtgatgattacttgaggttacaatacacttatcagtataaacacacttggagaaactttggtattatgtggtgtttcttaattggttatctggtcattaaggctgttgttactgaatttaagagacctgtcaaaggtggtggtgatgccttgattttcaagaagggtgctgaacaattcaaacattcaagtgatccagaatttactgcctcatcttccagtgatgcttcaaatgaagataaagtatctgatcctaacgctggtgagtttgaaaatttggaagcaactggagttttcatctggagagacgtttgctacactattccatatgatggcggtcaaaggatgttattggatcatgtttctggttattgtatccccggtacattaactgctttaatgggtgaatctggtgctggtaagactacattattgaacactttggctcaaagaaatgttggtattattactggtgatatgttaattaatggtcatcccattgacgctagttttgaaagacgtaccggttatgttcaacaacaagatatccatattgcagagttaactgtcagagaatctttacaattctcagcccgtatgcgtcgtgctcaagctattcctgatgaagaaaaaatggcatatgttgaaaagattattcaagtgcttgacatggaatactatgccgaagctctagttggtgaaattggtcgtggtttgaatgttgaacagagaaagaagttgtccattggtgtggagttggttgctaaacctgatttactattatttttggatgaacctacttctggtttggactctcaatcttcctgggccattattcaattttaa

SEQ ID NO: 210 - protein, 363 aa, Saccharomyces castelli
MAISLYSTYMIQLHSMRPWFKWISYILPIRYCFESMLNAEFHGRHMDCGGTLVPSGPGYENVSNDNRVCPFAGSKPGQSWVLGDDYLRLQYTYQYKHTWRNFGIMWCFLIGYLVIKAVVTEFKRPVKGGGDALIFKKGAEQFKHSSDPEFTASSSSDASNEDKVSDPNAGEFENLEATGVFIWRDVCYTIPYDGGQRMLLDHVSGYCIPGTLTALMGESGAGKTTLLNTLAQRNVGIITGDMLINGHPIDASFERRTGYVQQQDIHIAELTVRESLQFSARMRRAQAIPDEEKMAYVEKIIQVLDMEYYAEALVGEIGRGLNVEQRKKLSIGVELVAKPDLLLFLDEPTSGLDSQSSWAIIQF

SEQ ID NO: 211 - DNA, 4563 bp, Zygosaccharomyces rouxii
atgtcagctgcaaaggaagacagatttgaggacaaagattctctttcaaacgtttcgacgccaaatgaagaacactcttatgctgagtctttgcagagctacgaagttcacggtgcaacagcagaaccacatggcgctaacggcgacccagaagatctaagagctacttcgcaaatatcacgtcacataacgaatatgctatcaaatgaagatggtaccgaaaggttggctgctatgtcgcgtattatctctagcaaaacgaagaaagagatgcaagaatttgaagtcaacgacttagatttcgacttaagatctttgttgaactacttgagatcccatgccattgaacagggccttacgccgagggattctggtattgcgtttaaaaatgtgacagctattggtattgatgcttcagccgcttatggtccctctgtggaagaaatgttcagggatttgctgaaatggcctttgaaattcttcaagttcggaaagaaagacgcagtgccattgagagagattgtcagaaactgcactggtgttgtagagtccggtgaaatgcttttcgtagttggtagaccaggtgcaggttcttcgacattgttaaagtgtctttcaggtgaaattgatgattatgtccgtgtggaaggttcattttcctatgacggtcttgatcaagcagaaatgatgaagagatataaaggttacgttgtttactgccctgagatggatttccatttcccaaagattactgttaaggagacgatcgactttgcattgaagtgtaaaacacctcgtgttagagttgataatatgacaaggagccaatacgtcaatagtctgagagacatgtggtgtacagtctttggtttaagacacacctatgccactaaagttggtaacgaagtggtgagaggtgtttctggtggtgaaaggaagcgtgtttctttggtggaagcacaatgtatgatggcggctttatattcttgggataatgctacaagaggtttagatgcttctacagcattggaatttgctcaagctattagaactgctaccaatatgatgaacaattctgcgcttgtctgtatctaccaggcaggtgaaaacatttaccagttatttgataaagctaccgttctatacaatggtaagcaaatttactttggtcctgctgacaaagcagttgcttatttccaagatatgggttgggttaaaccacctagaatgacatctgcggagttcttgacatcggtgactgttgatttcgagaatagaacattagacatcaaaccagggtatgaggataaagtaccaaaatcgggtgctgagtttgaacagagatggttagagtctgaagaataccaagagttgttaagatactatgatgattatcaagcacgccatccagctgatgaaaccagggatagatttgaaactgcaaagagacaagtcttacaaaagggtcaaagaatgaaatctcaatttgccgtgaactatgctacccaggtttggctttgtatgatgcgtggattccagagagttaaaggtgattctacttataccaaagtttacttgtcctcatttatcaccaagggtctcattattggttccatgtttcaccaaattgatcataaaaatcaatcaaccactgcaggtgcttattcccgtggtggtttaattttctatgttctaatcttcgcagctgttacatctttggctgaaattgctaactcttttgccaacaggccaattgtggttaagcataaaacttattcgatgtatcacatttctgctgaatctttgcaggaaattattactgaaatgccaattaagttccttgcgattgtcctattggctgttacaacttattggatgccattgatgaagtttaccgccggtgcctttttccagtacttcctgtatttattcacatgtcaacaatgtatgtccttcattttcaaatttgttgctacaatgacaaaggatggtactactgcccacgctgttggtggtttagctgttttaatgtttacgactgcttgtggttttgtgataccaattggtgagatgcaccactggatgagatggttccactaccttaacccgttgacttatacatatgaatctctgatgtccactgaattccatgggagacaaatgttatgttccaaccttgtccccaatggtgccggttatgagaatgttccagttgctaacaaaatctgtgacgcagctggttccgtcaaaggacgtaagtatgtgagcggtgatgcttatgtgcaaaagaactatcatttcgcttacaagcatgcttggagagattggggtgttaatgttgtttggaccgctggttacattatgtttaacgttattgcttctgagtttttgaaacccctagaaggtggtggtgacttgttactgtacaagagaggccacatgcccaactttggtactgaaaatgctgatgccaagaccgccagtagggaagaaatgatggaagctctaaacggtcctggtgttgatttgaaaaaggttattgccgaaaaggatgtcttcacttggaacaacctagattacgttattccatatgatggtgctaccagacaattgttgtgcaacgtttttggttacgttcaacccggaaaaatgactgccttgatgggtgagtctggtgctggtaagacgactttgttaaatgttttggcccaaagagtcaatatgggtacagtgactggtgatatgttggttaacgctaagccattaccacaatctttcaataggtcctgtggttatgttgcacaagctgataaccacatggcggaattaagtgttagggaatccctaagatttgctgctgttttaagacaacctgcttctgttccaattgctgaaaaatatgactatgtggagaagattctgctattattgggtatgcaaaactatgctgaagcctatgtgggtaaaaccggtaagggtttgaatgttgagcagagaaagaaattgtctattggtgttgagttggttgctagaccagctctgttattgtttttagacgaacctacttctggtttggactctcaatctgcttggtctatcgttcaattcatgagggcattggctgattctggtcaatcgattttgtgtacgattcaccagccttctgctactctgtttgagcaattcgacagattattgttattgaagaaaggtggtagaatggtgtactttggtgacattggaccaaactcttctacgatgttgagttactttgagcgtgaatcaggtgtcaagtgtggtgtttctgaaaatcctgcagaatacattttgaactgtattggtgctggtgccactgcatctacgagtgctgattggggtgacctgtgggaaaagtcaccagaatgtgctaaagcgagggaagaagtcgaggaattacatcgcacgctacctagtaaaccaaccaatgaggatcctgagctatgtaccaaatttgcttcaacttatcctgttcagttgaagatgcttttcaagagaacgaatcttcaattttggagatcacctgtctatcttagagccaagttttttgaatgtattgcttgtgctcttttcgttggtttgtcttatgttcatttaaaccacacattaggagctgctcaagaggcctttgcatctgttttcatgctattattgattgctgttgcaatggtcaaccaaatgcatgttttcgcctttccatcaagagaattatatgaagtcagagaagcctcttccaataccttccactggtctgcgttgttactaatgcacttgctttttgaaattatatggtctgttgcatgccaattcttctgttgggtttgctactattggcctgcatactacagtggacgtgcatctcaggcgggtttcttctggttcttttatgttttgatcttcccaacatattactgttcttatggtttgtgggttctttacatgtctcctgatgttccttctgcatccatgatcaattctaatatttttgctgccttcttgctgttctgtggtatcttacaacctagagagaagatgcctgcattctggagaagattgatgtacaaaacttcaccctttacctatgtggttcaagctttggtaacatgtctggtccacaataaaaaggttgtttgtggtgaacatgagctgctgaggatggatccaccttctggtcaaacctgtgcttcctacttgcagaagtacaagtctgaacaaggtggttacattcgtaacccgggtgccacaagtgattgtgaatactgcccttatactgtacaggacgacgttgtgaggaaatataacatccattggggtcaaagatggagaaatttcggttttctgtgggcttacattattttcaacgtgtttttcatgttattctgttattacatcatgagagttaaggtgtggtctcttggtggtttgttgaatattaaaaattggattcctaagaggaaggatagacatgagaaggatacaactatcttccaagcaaagcccagcgataagaatatggttaaaaaatag

SEQ ID NO: 212 - protein, 1520 aa, Zygosaccharomyces rouxii
MSAAKEDRFEDKDSLSNVSTPNEEHSYAESLQSYEVHGATAEPHGANGDPEDLRATSQISRHITNMLSNEDGTERLAAMSRIISSKTKKEMQEFEVNDLDFDLRSLLNYLRSHAIEQGLTPRDSGIAFKNVTAIGIDASAAYGPSVEEMFRDLLKWPLKFFKFGKKDAVPLREIVRNCTGVVESGEMLFVVGRPGAGSSTLLKCLSGEIDDYVRVEGSFSYDGLDQAEMMKRYKGYVVYCPEMDFHFPKITVKETIDFALKCKTPRVRVDNMTRSQYVNSLRDMWCTVFGLRHTYATKVGNEVVRGVSGGERKRVSLVEAQCMMAALYSWDNATRGLDASTALEFAQAIRTATNMMNNSALVCIYQAGENIYQLFDKATVLYNGKQIYFGPADKAVAYFQDMGWVKPPRMTSAEFLTSVTVDFENRTLDIKPGYEDKVPKSGAEFEQRWLESEEYQELLRYYDDYQARHPADETRDRFETAKRQVLQKGQRMKSQFAVNYATQVWLCMMRGFQRVKGDSTYTKVYLSSFITKGLIIGSMFHQIDHKNQSTTAGAYSRGGLIFYVLIFAAVTSLAEIANSFANRPIVVKHKTYSMYHISAESLQEIITEMPIKFLAIVLLAVTTYWMPLMKFTAGAFFQYFLYLFTCQQCMSFIFKFVATMTKDGTTAHAVGGLAVLMFTTACGFVIPIGEMHHWMRWFHYLNPLTYTYESLMSTEFHGRQMLCSNLVPNGAGYENVPVANKICDAAGSVKGRKYVSGDAYVQKNYHFAYKHAWRDWGVNVVWTAGYIMFNVIASEFLKPLEGGGDLLLYKRGHMPNFGTENADAKTASREEMMEALNGPGVDLKKVIAEKDVFTWNNLDYVIPYDGATRQLLCNVFGYVQPGKMTALMGESGAGKTTLLNVLAQRVNMGTVTGDMLVNAKPLPQSFNRSCGYVAQADNHMAELSVRESLRFAAVLRQPASVPIAEKYDYVEKILLLLGMQNYAEAYVGKTGKGLNVEQRKKLSIGVELVARPALLLFLDEPTSGLDSQSAWSIVQFMRALADSGQSILCTIHQPSATLFEQFDRLLLLKKGGRMVYFGDIGPNSSTMLSYFERESGVKCGVSENPAEYILNCIGAGATASTSADWGDLWEKSPECAKAREEVEELHRTLPSKPTNEDPELCTKFASTYPVQLKMLFKRTNLQFWRSPVYLRAKFFECIACALFVGLSYVHLNHTLGAAQEAFASVFMLLLIAVAMVNQMHVFAFPSRELYEVREASSNTFHWSALLLMHLLFEIIWSVACQFFCWVCYYWPAYYSGRASQAGFFWFFYVLIFPTYYCSYGLWVLYMSPDVPSASMINSNIFAAFLLFCGILQPREKMPAFWRRLMYKTSPFTYVVQALVTCLVHNKKVVCGEHELLRMDPPSGQTCASYLQKYKSEQGGYIRNPGATSDCEYCPYTVQDDVVRKYNIHWGQRWRNFGFLWAYIIFNVFFMLFCYYIMRVKVWSLGGLLNIKNWIPKRKDRHEKDTTIFQAKPSDKNMVKK

SEQ ID NO: 213 - DNA, 4542 bp, Kluyveromyces polyspora
atgtcatttacagagagcaaagagagatattctcatgaaaaggatagctcttctgcgagtgattccatcggtgatgtacaaccttatgatggtaaggcacatgatatcacaggtaacgcagaagaaatgtctgtccaagaacaattatcaagaaatttaagtaaaattttatcaaataacgaaggtgtagaaagattagaatctttggcaagagttatctctaccaaaaataaaaaggaaatgtctgctttcgaagtcaatgatttggattttgatttacgtgcgttgctgaattatttaagatctcgtcaattagagcaagggatcgaaccgggtgattcaggtgtcgcttttaaaaatttaaccgcagttggtattgacgcttccgccgcatttggtccaagtgtagctgaatccattagagattttatttacttgccagtacatttgatgaacaagttacgtaaacaagatgataccccagtaagaaacattattcaaaattgtacaggtgtcgttgaatctggtgaaatgcttttcgttgttggtagaccaggtgcaggttgttcaactctattgaagtgtatctctggtgaaacttcagaattagtttctgtcgatggtgaattttcctatgatggtttggatcaacaagaaatgatgtcaaaatacaagagttatgtcatttactgtccagaattagatttccactttccaaagattactgtgaaagaaactattgattttgccttgaaatgtaagactccacgtactagaattgataacatgtctagaaaggaatatgtcgattctttaagagacatgtggtgtacagtatttggtttgagacatacttatgccactaatgtaggtaatgactttgttagaggtgtctccggtggtgaacgtaagcgtgtctctttagttgaagcccaagcaatgagtgcatctatctattcatgggataatgctacaagaggtttggatgcctctacagctttggaattcgcacaggctatcagaacagctacgaatatgatgaacaactctgctatcgttgctatctatcaagctggtgaaaacatttacgaattattcgataaggctactgttttatacgccggtaaacagatctattttggccctgccgataaagctgttcaatattttgaaaatatgggttgggtaaaaccaaacagaatgacatctgctgaatttttaactgctgtaacagtcgattttgaaaacagaaccctagaaataaaaccaggttatgaaaaccacgtaccaaagtcaggtactgaattcgaagagtattggttaaactcccctgaatatcaagaagttttacttgaatacaatgactaccaatctagacatccagctgaagaaacaagagagaggttagatatggctaagaagcaaagaagtcaagctggtgctcgtaaaaaatcacaatatactgttaactattggtctcaagtttattattgtatgattcgtggtttccaaagagttaagggtgattctacctatactaaggtttatttggcctcttttttgattaaaggtttagttgttggttctatgttccacagaattgacccaaaatctcaatcaactacttctggtgcttattctcgtggtggtattctgttctatgttttattatttgctgctgttacatctttagctgaaattgctaactcttttgctactagaccaatcatagtgaagcataaaacgtattctatgtaccatttatctgctgaatctttacaagaaattattaccgaaattccaaccaagttaactgctattattatcttgtctttggtttcttattggattccatatttgaaatttcaagccggtgcttttttccagtatttgctatatctgtttactattcaacaatgtacttcttttattttcaagttcatcgctactttgaccaaagatggtgttactgctcacgcttatggtggtctatacgttttaatgttaactgttttcactggctttgtcttacctattcctgaaatgcatcattggattagatggttccactatatcaatccattaacttatgctttcgaaagtttaatgtctaccgaatttcatggtagagaaatgttatgcagtcaattgattccagatggtcctggttacgaatcatattctgttgctaataaaatctgtaacattgctggtgcagtcaaaggtaatttatatgttaacggtgatgcttacattttaaaacaatatcactttgcttataaacacgcttggagagactggggtgtaaacatcgtctggacttttggttacattgtcgccaatgttttattgtcagaatttttgaaacctgttgaaagtggtggtgatttattgctatacaagagaggacatatgccagattttggtactgaaagtgctgaagctaaaaccgcttcaagagaagaaatgatgcatgccttaaatggtgaaaatgtcgatttagattctgttattgctgcaaaagatgtttttacatggaatcatctatattacacaatcccatatgatggtgccaccagacagttgttaagtgatgttttcggttatgtgaagcctggtaaaatgacagcattaatgggtgaatcaggtgctggtaaaactaccttattgaatgttttagctcaaagaattaatatgggtgtcattaccggtgatatgttggtgaatgctaaacctttacctgcatctttcaacagatcatgtggttacgttgctcaggccgataatcatatggctgaattgtctgttagggaatctctacgttttgctgctgaattgagacaaccaagatctgtatcaatcgaagaaaaatatgaatacgttgaaaaaatcattaagttattgggtatgcaaaattatgccgaagctttggtaggtaaaaccggtagaggtttaaatgtcgaacaaagaaagaagctatctattggtgtcgaattagttgccaaaccatcattattattattcttggatgagcctacatcaggtttggattcccaatcttcatggtctattgttcaattcttaagagcattagccgattctggtcaatcaattttatgtacaatccatcaaccttctgctactttatttgaacaatttgatagattattactattaaagaagggtggtaaaatggtttatttcggtgatattggtccaaattcttctactttgttatcttactttgaacgtcaatctggtgttaagtgtggtgtttctgaaaaccctgctgaatatattttgaattgtattggtgccggtgcaactgcttctgcttctgctgattggcatgatctatgggttgcatctccagaatgtgcagcagctagagccgaagttgaagagcttcacaaaactttggctagtagaccagtagaaaacaatgccgagttaaatggcagatttgccgcctcatatttgactcaattaatgtgtgttttgaggagaacttcgattcaattttggagatcccctgtttatattagagcaaagttctttgaatgtgttagttgtgcgttgtttgtcggtttatcttatgttggtgttaatcactctatcggtggtgcacaagaagctttctcatctattttcatgttattattgattgcattggccatgattaaccaactttctgtttttgcctttgatagtagagaattgtacgaagtcagagaagctgcgtcaaatactttccactggagtgctttattattatgtcatgcagctgttgaaattggttggtccactttatgtcaattcttctgtttcttattctactactggcctgctcaatatagtggcagagcttctcatgcaggtttcttcttcttcttctatgttttaattttcccaatttacttcgtttcttatggtttgtggttattgtacatgtcgccagatgtcccatctgcatccattatcaattctaatttatttgctgcgatgttattattctgtggtatcttacaacctagacaaaaaatgcctgctttctggagaagattaatgtataacgtttcaccatttacttatgtcgtccaggctttagtcgccccattggttcacaataagaaggttatctgtgctgaaaatgaatttgcaattatggatccacctgagggccaaacatgtggtacatatctggaaacttacatcaacaataatactggttatttgactaatccaactgccactgctgattgtagatactgtccatactctgttcaagatgaagttgttgctcagttcaatatcaaatgggattacagatggagaaactttgggttcatgtgggcttacatttgctttaacttctgtgccatgttgttctcttattatatcatgagagttaaagtatggtctttaaaatcggtgctaaatttcaagaaatggttcaatggtccaagaaaagaaagacacgaaaaagattccactattttccaacagaaaccaaccgattccaaaaaagtcagcaagaactaa

SEQ ID NO: 214 - protein, 1513 aa, Kluyveromyces polyspora
MSFTESKERYSHEKDSSSASDSIGDVQPYDGKAHDITGNAEEMSVQEQLSRNLSKILSNNEGVERLESLARVISTKNKKEMSAFEVNDLDFDLRALLNYLRSRQLEQGIEPGDSGVAFKNLTAVGIDASAAFGPSVAESIRDFIYLPVHLMNKLRKQDDTPVRNIIQNCTGVVESGEMLFVVGRPGAGCSTLLKCISGETSELVSVDGEFSYDGLDQQEMMSKYKSYVIYCPELDFHFPKITVKETIDFALKCKTPRTRIDNMSRKEYVDSLRDMWCTVFGLRHTYATNVGNDFVRGVSGGERKRVSLVEAQAMSASIYSWDNATRGLDASTALEFAQAIRTATNMMNNSAIVAIYQAGENIYELFDKATVLYAGKQIYFGPADKAVQYFENMGWVKPNRMTSAEFLTAVTVDFENRTLEIKPGYENHVPKSGTEFEEYWLNSPEYQEVLLEYNDYQSRHPAEETRERLDMAKKQRSQAGARKKSQYTVNYWSQVYYCMIRGFQRVKGDSTYTKVYLASFLIKGLVVGSMFHRIDPKSQSTTSGAYSRGGILFYVLLFAAVTSLAEIANSFATRPIIVKHKTYSMYHLSAESLQEIITEIPTKLTAIIILSLVSYWIPYLKFQAGAFFQYLLYLFTIQQCTSFIFKFIATLTKDGVTAHAYGGLYVLMLTVFTGFVLPIPEMHHWIRWFHYINPLTYAFESLMSTEFHGREMLCSQLIPDGPGYESYSVANKICNIAGAVKGNLYVNGDAYILKQYHFAYKHAWRDWGVNIVWTFGYIVANVLLSEFLKPVESGGDLLLYKRGHMPDFGTESAEAKTASREEMMHALNGENVDLDSVIAAKDVFTWNHLYYTIPYDGATRQLLSDVFGYVKPGKMTALMGESGAGKTTLLNVLAQRINMGVITGDMLVNAKPLPASFNRSCGYVAQADNHMAELSVRESLRFAAELRQPRSVSIEEKYEYVEKIIKLLGMQNYAEALVGKTGRGLNVEQRKKLSIGVELVAKPSLLLFLDEPTSGLDSQSSWSIVQFLRALADSGQSILCTIHQPSATLFEQFDRLLLLKKGGKMVYFGDIGPNSSTLLSYFERQSGVKCGVSENPAEYILNCIGAGATASASADWHDLWVASPECAAARAEVEELHKTLASRPVENNAELNGRFAASYLTQLMCVLRRTSIQFWRSPVYIRAKFFECVSCALFVGLSYVGVNHSIGGAQEAFSSIFMLLLIALAMINQLSVFAFDSRELYEVREAASNTFHWSALLLCHAAVEIGWSTLCQFFCFLFYYWPAQYSGRASHAGFFFFFYVLIFPIYFVSYGLWLLYMSPDVPSASIINSNLFAAMLLFCGILQPRQKMPAFWRRLMYNVSPFTYVVQALVAPLVHNKKVICAENEFAIMDPPEGQTCGTYLETYINNNTGYLTNPTATADCRYCPYSVQDEVVAQFNIKWDYRWRNFGFMWAYICFNFCAMLFSYYIMRVKVWSLKSVLNFKKWFNGPRKERHEKDSTIFQQKPTDSKKVSKN

SEQ ID NO: 215 - DNA, 4539 bp, Ashbya gossypii
atgagcgacgagcagtgccaatcagatcatcagtggccaatggagtcttcaaaggtaccgccggcaggtctgagcctgtcccgagtgagtacaggcgctagtacgagcgcggaccccgcgcatcggccctatgtgggcctcgcggaggaccgcgaagagcaagaagtaatccggtcgcttgcgcggaccctgagtggttcgtcgggcgcggccgggcgcgactaccaaacgggtacggcggacgagttagcgtttttcggcgctaacagcgatccgcggctggacccagaatctggggaattcgactcacagttcttcgtgcgcacgctgcgcaagctgtatatgagcgaccccgaccactacaagcctgcggagctgagtgttgtgcttcggaatctgcgtgtgtgcggtgaggctgcggacacggattaccaggcgacggttggaaactggccgtggaaaacggcgcgcagtttgtacgacatgacgttcaggcgcggccacaccaaggccgagttcgacatcctcaagccgttggacgcggtgttcgaggcgggccggctgtgcgtggtgcttgggcgccctggtgcgggttgctcgacgctgctgaagacggtgggcgcacggacctacgggtttaacgtcgcgcccgagtctgaggtcagctacagtggattcacgcagaaggagatcagcaaaaacctgcgcggtgaggtgatctactctgcggagatggacacgcactttgcgtctctgcccgtcggatacacgttggagtttgcggcgcggtgccgctgtccgcaggtgcgtccagggggcgtgagccgggagacgtactacaagcactacgcttctgcggtgatggcaacgtacgggttatcgcacacacgtaacaccaaagtgggtaacgactatatccgtggtgtgtccggtggtgagcgtaagcgtgtgtcgcttgcagaagtcaccctggcaggtgccaaggtgcagtgctgggacaactccacccgtggtctggactctgcgaccgcgctggaatttgtgcgtgcgctgagggacaatgcgcacgtgatgcacacgacacagttgattgccatctaccagtgttcccaggacgcgtacgatctatttgacgacgtgctggtgctatatgagggttacatgatctacttcgggccacgcgagttcgctaaggactacttcttgcgcatgggctgggcgtgccctccacaacagacgtctgctgactacctgacgtcggttacgtcgcctgctgaaagacaaccacggccaggctacgaggataaggtgcctcggacagccaaggagttctacgaccgctggatggcatcgccagagcgcgctgccgttcaggagcgtatcaacatgcacatggcagattacgagaccggtgttgcccgtcagcaattgaaggaacatcacaaaagccgtcaggccaagcatatgcgtccatcttcgccttacttgatttccttctacatgcaattccgcgctgttgtggatcgtaacttgaagcggctcggcggtgacccatgggtgtacctgttcaatatcctttcgaacacgatcatgggtctgatccttgcctcctgttttttcaatcagaaagaagataccgcgtcgttcttctatcgtggctctgcgcttttcactgctgttttgttcaattcgttttcttctatgttggagatcatgtctctgtttgaggcccgtgcaattgtggaaaaacacaagtcgtatgctttctatcgcccttctgctgatgcttttgcttcgatctttacggaactaccgtctaaggttataacctgtgtctctttcaatataccgttctatttcatggtgaacttgagaagatctgcaggagccttcttcttttacctcctaatatctatgacttccacctttgcaatgtcgcatttgttccgtactctcggtgctgccacgacttcgctatacgtgactatgttgcccgtttcgattctattgcttgcgatatccacgtatgtcggtttcgttattcctcagaagaacatcgtggggtggtccaagtggatcttctacttgaacccaattgcgcgttcgatggaagccatggttgctaacgagttcgatgggcgcacttttgagtgttcgcagatgatgccttctggtcctgcttacgaaaatgtgccccttgccaacaaggtctgtgttgccgtggggtctctacctggtgagaccaccgtttctggtacacgttacatggaactttcctacgattacttggccaagcataaatggagaaactgggccatcgttcttgcctatgcaattttcttcttgggtctttacctgttattaattgagtataacaagggtgaaatgcagaagggtgaaatggccgtgttccttcggtcgaccctgaagaaaataagaaagcagaacaaggccgttaaaggcgacgtcgaatctggtaacgcgcagggcaaagaatctagtaccatagactctgaccaatctcgggaactgatcaagaaaattggctctgataagattttccactggcgtaatgtttgctacgatgttcagattaaaaaggagaccagacgtatcttgaccaacgtcgatggttgggtgaagcctgggaccctaactgccctgatgggctcctccggtgctggtaagacgactttattggatgttttggctaaccgtgtccgtgtgggtgttgttaccggtgacatgtttgtcgatggtctacctagaggcgcatctttccaacgtaacaccggttactgtcaacaacaagatcttcatgggtgcacccagactgttcgcgatgcattgaaatttagtgcttatttgcgtcagccgcaatccgtgtcagaagctgaaatagacgcttatgttgaggatataatcagattgctggagatggaagcctatgcggatgccattgttggtgtgactggtgagggtctaaatgttgaacagagaaagcgtctcacgattggtgtagaacttgttgccaagcctgagttgctattgtttttggatgagcctacatctgggttagactcgcaaactgcttggtccgtctgtcagctcatgagaaagctagcgaatcacggacaagcagttctgtgtaccattcaccagccttcggccattttgatgcaggagtttgaccgtctattgctcttggctagcggcggtagaactgtttacttcggtggactaggtaaaggatgtgcaactatggttgagtatttcgagaaacatggatcgcaaaaattccctgaaggatgtaatcctgcagaatttatgttggagattattggtgccgctcctggatcgcatgctcttcaagactatcacgaagtttggaagaactctgaggagtaccgttctgttcaagaggagttgttgagaatggagacggaattgagcaaaaagccaagaaccgagagcccagagcagaacagagaatttgctgcctccctatggtaccagtataaggttgttagtaagagagtcttccaacaatactggagatcaccaggttatttgtggagtaagatttttatgggtacattctccgctctcttcatcggtttttcgttctttaaatctaagtcatcgatgcaaggtatgcagaatcagatgtttgcaactttcttattcttattgattatcaacccattgattcagcagatgttaccacaatatgaggagcaaaagaagacctggtatgaagtgagggaagagccattcgaagccattttcttggaaggcgttcatcttatctcagttaactgcagactcccatgggctatatttgtcggtacactagcattcttctctgtttactatccagttgggttttacaataatgcagttgatacatcggatcggtctgaacgtgggttcctcttctggttattggcagtgtgttattatatcttttcagctaccttcggatacttctgtatcgcacttttgggaagccgtgaatctgcagcgatgtttgcgaactttgtcttcatgatctggacagtcttctgtggtgttctagtcaatggtgacaacctgccacgcttctggatctgggcctaccgtatctctccattgacctacctggtgtcttcaattatgtcaacaggtatggcgaaggctaaaatccagtgtgctccggaagaattagtcaaattcattccaccagcgggtcaaacttgtgaacaatacctccggccattccaaagctatgctcaaggtactgcgcttctaaaccctacagccaccgacctgtgcactatgtgtcctatgcagagctcagatactttccttgcaggattaggcatttactacaaaaacaggtggagagactggggtatctttatggtcttcatttttacgaacatcgccggtttcattctattctactggttcttgcgtgttcctaaagccacaggtgtaaccatcaagaaggccaccaatgaggaggaggacgaggagaaaggtcagcagcgcaagtaa

SEQ ID NO: 216 - protein, 1512 aa, Ashbya gossypii
MSDEQCQSDHQWPMESSKVPPAGLSLSRVSTGASTSADPAHRPYVGLAEDREEQEVIRSLARTLSGSSGAAGRDYQTGTADELAFFGANSDPRLDPESGEFDSQFFVRTLRKLYMSDPDHYKPAELSVVLRNLRVCGEAADTDYQATVGNWPWKTARSLYDMTFRRGHTKAEFDILKPLDAVFEAGRLCVVLGRPGAGCSTLLKTVGARTYGFNVAPESEVSYSGFTQKEISKNLRGEVIYSAEMDTHFASLPVGYTLEFAARCRCPQVRPGGVSRETYYKHYASAVMATYGLSHTRNTKVGNDYIRGVSGGERKRVSLAEVTLAGAKVQCWDNSTRGLDSATALEFVRALRDNAHVMHTTQLIAIYQCSQDAYDLFDDVLVLYEGYMIYFGPREFAKDYFLRMGWACPPQQTSADYLTSVTSPAERQPRPGYEDKVPRTAKEFYDRWMASPERAAVQERINMHMADYETGVARQQLKEHHKSRQAKHMRPSSPYLISFYMQFRAVVDRNLKRLGGDPWVYLFNILSNTIMGLILASCFFNQKEDTASFFYRGSALFTAVLFNSFSSMLEIMSLFEARAIVEKHKSYAFYRPSADAFASIFTELPSKVITCVSFNIPFYFMVNLRRSAGAFFFYLLISMTSTFAMSHLFRTLGAATTSLYVTMLPVSILLLAISTYVGFVIPQKNIVGWSKWIFYLNPIARSMEAMVANEFDGRTFECSQMMPSGPAYENVPLANKVCVAVGSLPGETTVSGTRYMELSYDYLAKHKWRNWAIVLAYAIFFLGLYLLLIEYNKGEMQKGEMAVFLRSTLKKIRKQNKAVKGDVESGNAQGKESSTIDSDQSRELIKKIGSDKIFHWRNVCYDVQIKKETRRILTNVDGWVKPGTLTALMGSSGAGKTTLLDVLANRVRVGVVTGDMFVDGLPRGASFQRNTGYCQQQDLHGCTQTVRDALKFSAYLRQPQSVSEAEIDAYVEDIIRLLEMEAYADAIVGVTGEGLNVEQRKRLTIGVELVAKPELLLFLDEPTSGLDSQTAWSVCQLMRKLANHGQAVLCTIHQPSAILMQEFDRLLLLASGGRTVYFGGLGKGCATMVEYFEKHGSQKFPEGCNPAEFMLEIIGAAPGSHALQDYHEVWKNSEEYRSVQEELLRMETELSKKPRTESPEQNREFAASLWYQYKVVSKRVFQQYWRSPGYLWSKIFMGTFSALFIGFSFFKSKSSMQGMQNQMFATFLFLLIINPLIQQMLPQYEEQKKTWYEVREEPFEAIFLEGVHLISVNCRLPWAIFVGTLAFFSVYYPVGFYNNAVDTSDRSERGFLFWLLAVCYYIFSATFGYFCIALLGSRESAAMFANFVFMIWTVFCGVLVNGDNLPRFWIWAYRISPLTYLVSSIMSTGMAKAKIQCAPEELVKFIPPAGQTCEQYLRPFQSYAQGTALLNPTATDLCTMCPMQSSDTFLAGLGIYYKNRWRDWGIFMVFIFTNIAGFILFYWFLRVPKATGVTIKKATNEEEDEEKGQQRK

SEQ ID NO: 217 - DNA, 4185 bp, Saccharomyces bayanus
atgtcgatttcaaagtattttactcctgttgctaacgggtcacttactttcaatggtgcaaatattcattttggttctaatgcgcaaagtgactctcaaaagagttatgatgccgaaggtagtacacccccttctgccgatcaattaaatgatataacctttcaggcagaggctggtgaaatggttttggtgttgggtaatcccacatctactcttttcaaaactttgtttcatggtaaaacaagtttatcatactctcctcaaggctcgattaaatttaaaaataacgagttcaaaaacttttccgataaatgtcctcaccagatcatttataacaatgaacaagatgtccatttcccttttttgacagtagaacagacaatagattttgccttgagctgtaagtttgatattccaaagggtgagcgtgatgaaataagaaatgaacttctaaaggaatttggcttatctcatgtgttaaaaactattgtcggtaacgattttttccgtggtgtttctggtggtgaacgaaaacgtatttctattattgaaacgttcattgcaaacggttctgtttacctatgggataactctacaaaaggtcttgattctgctacagctctagactttttggagatccttagaaaaatggcaaaagctactcgttctgtcaacttagtcagaatatctcaggccagtgataaaattgttgataaatttgataagattcttatgttatctgattcctaccaacttttttatggtaccgtcgatgagtgcctagcttatttccatgatactttaggtattgaaaaagatccaaatgactgtattattgagtatctgacttctattttgaattttcaattcaaaaacaagaatgtcggagacctatcaaactcatcatcttctagcgttctcaagactgccgcaaaagaagtgacgaagtatacatataattctgatttggatttatatgaccaatggaagcactcttcgtattataacaatataaagcaacagattgcagagtctcaagttgatgactctgtcaacgaggtcgatccctctgatatttcacctatttttaatattccgttgaagaaacaattatcatattgtacaaagagagcttttcaaagaagtttgggtgataaaacttacatgacagcacaacttatttccgtcgttattcaatctttggtcattggttctttgttttatgagattccattaaccaccattggttcatactcaagaggttctttaacctttttctccatccttttcttcactttcctttctcttgcagatatgccaattgctttccaaagacaacccattgtcaaaaagcagtctcagcttcacttctacactaactgggttgaaactctgtcaaccacagcgttcgattattgtttcaagttttgtttggttgtcgtattcagcatcatcctatatttcctagctcacctgcaatacaaggcggcaagattttttattttcttgctgttcctttccttttacaatttctgcatggtgtcactgttctctctgacgacgttgattgcgccaaccatttcagttgcaaatttgttcgctggtattttgttgctagctatagcaatgtatgcctcttacgttatctacttaaacaacatgcatccttggttcgtgtggattgcctacttaaatcccgcaatgtacgctatggaagctatactagccaacgaactttacaatttgaaactagattgtagtgaaactattgttccaaggggccctacttatgaggatgttccattttcacataaggcctgtgcttggcaaggtgcaaccctaggtaatgattacgttagaggtcgtgattatttgaagcaaggtttatcttacacatataatcacgtgtggagaaactttggtattattattggtttcttggtgttcctcatcgcctgcactctatttgcgtctcaatacatcaagccttatttcaataaggatgaaatagagcgctctaatggtggtttgacaaggtggataccattcttcaacaagaagaggaataccagctcttccacaagaagtggtagcaggtacaatggtatgccaaaatcacattctgtttcttcatcttcgtctagtatctctgctctcccataccaggtatcgccttcaaataaggaaatggcactagcagattaccacgagcaagggaacatggaaacagtagaaactcagaagcacgttatttcttggagaaatattaactacacagttggtgacaagaaactgatcaacaatgcgtccggtttcatcagttctggtttgacagctttaatgggtgaatctggtgcaggtaagacgactttattaaacgtgttatcacaaagaattgagtctggtgttgttaccggtgaaattttgattgatggccaaccactggcggatgaggattcattcaaaagaagtattggttttgttcaacaacaggatttacacctggatttattgactgtggaagaatcattggaaatttcctgtattttaaggggtgatggtgacagagcttacttggacactgtttcaaaattactaaaattaccatctgaaattttggttgccgatttaaaccccactcaaaagaaattgctatccattggtgttgagcttgttactaagccttctcttttgctgtttttagatgaaccaacttctgggctagacgctgaggctgcattaacaattgtcaaatttttaaaacaactttcgttacaaggccaagctattttttgtactatccatcaaccaagtaaaagtgttatcagccatttcgacaatattttcttattaaagagaggtggtgagtgtgttttctttggcccaatggacgatgcttgcggatacttcatgtctcacgacaacacattagtctacgataaagagcgtgataatcccgccgatttcattattgatgccgtgggtaacagcaactcttcggttgaggaagacggaatgacggaaggtttcacattgaacaaggaatctagaaactggggcacattatgggaatcatctccagagaaaaagttagttgaaagagaaacagctaggttggaagatgatgctcgtgcctctggtgttgattacacaacctcactatggaaacagccttcatatttacaacaactaactctcattacgaaaagacaatatatttgtaccaaaagagatttgacttacgttatggctaaatacagtttgaatggtggtgccggtttattcattggtttctcattttggaacattaagcacaatattattggtttgcaagatagtattttcttctgtttcatggctctttgtgtttcatctcctttaattaatcaaatccaagacaaagcattgaaaacaaaacaagtctacattgccagagaagctagatcgaacacctaccattggaccgttcttcttttatcgcagtgcattattgaattaccactggcacttacaagttcagcattatttttcgtttgcgcgttcttttgctgtgggttcaacaatgctggctggagtgctggagttttctttttgaactatatgcttttctctgcttattatgccacacttggtttgtggttaatctacactgctcctaatctgcaaaccgctgcggttttcgttgcctttatttacagtttcacagcatcattttgtggtgttatgcagccctactcattgttcccaactttctggaagtttatgtacagagtttcaccatacacatattttgttgaaacatttgtcagtatcctattacacgattgggaaatcaagtgtgatatgagtgaaatggttcctggacaacctatgacaggacaaacttgtggcacattcatggaagcctacattgaagaatatggtggttacttgcataataaaaacaccttcaccgtctgtgcttactgtacgtacactgttggtgacgatttcctaaaaaatgaaaacatgagctacgaccatgtttggagaaactttggtatcgaatgggcttttgttggtttcaatttctttgcgatgtttgctggttattacttaacctacgtggcaagagtatggcctaaagtttccaaattcatctctaaggtaattccccacaaaggaaaaaaatctgcacaaaactaa

SEQ ID NO: 218 - protein, 1394 aa, Saccharomyces bayanus
MSISKYFTPVANGSLTFNGANIHFGSNAQSDSQKSYDAEGSTPPSADQLNDITFQAEAGEMVLVLGNPTSTLFKTLFHGKTSLSYSPQGSIKFKNNEFKNFSDKCPHQIIYNNEQDVHFPFLTVEQTIDFALSCKFDIPKGERDEIRNELLKEFGLSHVLKTIVGNDFFRGVSGGERKRISIIETFIANGSVYLWDNSTKGLDSATALDFLEILRKMAKATRSVNLVRISQASDKIVDKFDKILMLSDSYQLFYGTVDECLAYFHDTLGIEKDPNDCIIEYLTSILNFQFKNKNVGDLSNSSSSSVLKTAAKEVTKYTYNSDLDLYDQWKHSSYYNNIKQQIAESQVDDSVNEVDPSDISPIFNIPLKKQLSYCTKRAFQRSLGDKTYMTAQLISVVIQSLVIGSLFYEIPLTTIGSYSRGSLTFFSILFFTFLSLADMPIAFQRQPIVKKQSQLHFYTNWVETLSTTAFDYCFKFCLVVVFSIILYFLAHLQYKAARFFIFLLFLSFYNFCMVSLFSLTTLIAPTISVANLFAGILLLAIAMYASYVIYLNNMHPWFVWIAYLNPAMYAMEAILANELYNLKLDCSETIVPRGPTYEDVPFSHKACAWQGATLGNDYVRGRDYLKQGLSYTYNHVWRNFGIIIGFLVFLIACTLFASQYIKPYFNKDEIERSNGGLTRWIPFFNKKRNTSSSTRSGSRYNGMPKSHSVSSSSSSISALPYQVSPSNKEMALADYHEQGNMETVETQKHVISWRNINYTVGDKKLINNASGFISSGLTALMGESGAGKTTLLNVLSQRIESGVVTGEILIDGQPLADEDSFKRSIGFVQQQDLHLDLLTVEESLEISCILRGDGDRAYLDTVSKLLKLPSEILVADLNPTQKKLLSIGVELVTKPSLLLFLDEPTSGLDAEAALTIVKFLKQLSLQGQAIFCTIHQPSKSVISHFDNIFLLKRGGECVFFGPMDDACGYFMSHDNTLVYDKERDNPADFIIDAVGNSNSSVEEDGMTEGFTLNKESRNWGTLWESSPEKKLVERETARLEDDARASGVDYTTSLWKQPSYLQQLTLITKRQYICTKRDLTYVMAKYSLNGGAGLFIGFSFWNIKHNIIGLQDSIFFCFMALCVSSPLINQIQDKALKTKQVYIAREARSNTYHWTVLLLSQCIIELPLALTSSALFFVCAFFCCGFNNAGWSAGVFFLNYMLFSAYYATLGLWLIYTAPNLQTAAVFVAFIYSFTASFCGVMQPYSLFPTFWKFMYRVSPYTYFVETFVSILLHDWEIKCDMSEMVPGQPMTGQTCGTFMEAYIEEYGGYLHNKNTFTVCAYCTYTVGDDFLKNENMSYDHVWRNFGIEWAFVGFNFFAMFAGYYLTYVARVWPKVSKFISKVIPHKGKKSAQN

SEQ ID NO: 219 - DNA, 4017 bp, Saccharomyces kluyveri
atggctaaaccagttccagtgcttcttgatcagttggctgattactttactcccataaaagaaagctccttgtcctttcttaatgctacagtcacttcaaagagagtcgaccaagatttagagaagttccaaaatggtggctgcattaaggatctgactgcccatataaaaggcggagaactggtgcttaccatgaactacaaggattcttcgatcttagagccactgtcccgctcttcgttgttcaaagtctctcaaggttctgtacttttcaaggattacgattacgaggattttgccaagcattgccctcaccaagttatctataacaacgaaaaggatgttcatatacctcatttaaccgttgagcaaacagtagatttcgcaattagttgtaaattcaattacaaaccattcgtcaaccattcgatccgcgatgttttgctaaaaacctttgggctagagcgtgcgcgtcacactattgtgggcgacgaccatgtgagaggcatttcaggtggtgaaagaaaaagactgtctattatagagagtttcattgcgaacggctcgctatacttgtgggataattccaccaaaggcttggactcatccactgcgttagaatttatccagtgcctccgttcaatggccaaattaacccgaaccataaacatagtcaaaatttcacaagctagcgacaaactagtcgagcaatttgataaaatcctaattattctagaaaactaccaggtattttatggtacagtctcagactgcatacagttcttcaaggacctagggttcaggaaggatccacatctgtgcgacatcgagtttttaaccgccattataaataagaatctgaaaagccccaaagtttcatcagaagaagatatttacacccactggataaaatcgaaatattatgctggtgtaagggcgcagttatctgtgaatcaaaataacaaccatgtcacaaatcctatcagcaagatagacccacaagacctctctccgttatatggagtatccacttacaagcagctaaagagttgcgtcatcagagcctttcaaagagctttgggcgatagaacgtacttgactgcacagctaatatcgatcataattcagtcattggttataggctctctgttctacagcgttccaaaaacaacgattggctctttttccagaggttctttgacattctttgcccttctgttctttacatttaattgcttagcagatgtgcctattagttttgtcagaaggcccgttattagcaaacagagacagatgtatttttaccagccttggattgaaaatttggcctcgacaatttatgagtttccttacaaattcatccttgtattggtatttacaatcattctgtactttcttgctcactttcagtacagtgcagctaggttctttgtgttccttctgtttttggtcacggcgaattttgtcatgtccgtgcttttccaaacgattgcttatctgtcaccgacggtggcagttgccaacgctgctggaggcgttcttctgctggccatatcgatgtacgcttcttatgtcatctacctgaaatctatgcgtccttggtttaaatggatagcgtacatcaaccctgtcatgtatgctatggagtccatgctatccaatgagctgttcaacatggatttagattgtaccgattcaataattcctcgaggcccgacttacgataacgtttcttttagccataaagtatgtggttggcagggtgctaaactgggccacagttcagttaaaggtagagaatatttaaatgacgcattggggtacagttaccagcacgtctggagaaactttggaattttaattgggttttcggtctttttcacagtattctccttactagcatcccaatacatcacgccaagatatgatggtaagacctttaaacttttcaagaaaaaaaattacccaaaacgctcttcaaaagcccatgatgatgttcctttgacagacgtggaatttttccgatttgaatccgttatggataaagccgaaaagaatacagagactgacaactctttatgcactgaacaggctgtactcaaatcttgtgacacaaacgttgtttcttggaaaaatgttaattacactgtaaatggaaagcatttacttaaagacgtatccggctatatcagttccggtttaaccgcattgatgggtgaatcaggtgctggcaaaaccactcttttgaatgttatctcccaaagaattgaaaaaggcgtcgtaaacggtgaattattagtgaatggctgtgctgtcaaggacaagaatgcatttaaaagaagtgttggttacgtacaacagcaagacgtccacatcaacctcttaacagtttgggagtccctagaaatttcttgccgcttaagaggcgacggtgatttgttatacgctgagaaagttctcgatatgctgaaacttccaagggaaaaactattcaaagacttaaatccggcggaaaagaagctgttatcaataggtgtagagttggttaccaaaccttctctactactatttctggatgagcctacttctggtcttgactcagaagctgccgttaccatcataaagtttttaaaaaagctgacagcacagggccaagctgtcttctgcactattcaccagcctagtaaaaacatttttagttactttgacaatgttttgctgctaagaaaaggtggtgagtgcatctattttggtccgagggaccaaatttatgattatgtcaaacgtcactattccatttcttatgacaaagagaccgaaaatccagcagaattagttctagatgccatcggtgcaggagcgaattccgattctaatatcggttggctcagcatctggaattcttccaaagagaagaaagacattacagatataatctcgcaactagaagatgaggcattagccgatgggacgaattacattgaacttcttcacgaaacaccttcttacttgactcagctatttatcgtgacaaagagacagtacctgagtattactagggataggtcgtacatgacatcgaaaattttgctaaacgtggttgctggacttttcattggattcacattttggaaaacgaagcataacatcattgggctacagaatctaatttttacggtgtttatggcactgtgtatttctgatcccttgatcaaccagttgcaagccaaggcctttgaaccgaaagaggtttttatcacaagggaatccaaatcaaatacgtaccactggtcggtgttattattatcacagctgttagtggagatcccgcttgtgttgattggatccacatttttatacctttgcttctacttttgtctgggcgttgacaactcccctcacattgcaggtgtattctatctcaactatatgctatttgcgatctattatctgacttttgggttgtggctgatgtacatgtgtactgatttacagacatctgcagtttttgtagcgtttctgttcagctttactgtatccttttgtggtgtcatgcagccatacgcactatttcccaatttctggaagtttatgtacagagtttcaccatacacttactttgtggatacctttgtaagcttgttgctgcacgaaagaaaggttatttgtgataccagtgagttcgctccttctcagcctctggcaggacaaacatgtggccaattcatgaaggacttcatcgacgagcacggaggttatctactcaatccaaatgcaccctttgtttgtgcctactgctcttatactagtggagacgagtttttatccattcaaaacatgggctatcataacagatggagaaattttgggatttgctgtgcctttgttgcgttcaatctgttcgccatgtttagtggattttatattacatccgtgaaaaaactctggagtgtcttatttgaaaaattctcaatggtactcttgaagaaaaagagatttggccaaaagcacggttag

SEQ ID NO: 220 - protein, 1338 aa, Saccharomyces kluyveri
MAKPVPVLLDQLADYFTPIKESSLSFLNATVTSKRVDQDLEKFQNGGCIKDLTAHIKGGELVLTMNYKDSSILEPLSRSSLFKVSQGSVLFKDYDYEDFAKHCPHQVIYNNEKDVHIPHLTVEQTVDFAISCKFNYKPFVNHSIRDVLLKTFGLERARHTIVGDDHVRGISGGERKRLSIIESFIANGSLYLWDNSTKGLDSSTALEFIQCLRSMAKLTRTINIVKISQASDKLVEQFDKILIILENYQVFYGTVSDCIQFFKDLGFRKDPHLCDIEFLTAIINKNLKSPKVSSEEDIYTHWIKSKYYAGVRAQLSVNQNNNHVTNPISKIDPQDLSPLYGVSTYKQLKSCVIRAFQRALGDRTYLTAQLISIIIQSLVIGSLFYSVPKTTIGSFSRGSLTFFALLFFTFNCLADVPISFVRRPVISKQRQMYFYQPWIENLASTIYEFPYKFILVLVFTIILYFLAHFQYSAARFFVFLLFLVTANFVMSVLFQTIAYLSPTVAVANAAGGVLLLAISMYASYVIYLKSMRPWFKWIAYINPVMYAMESMLSNELFNMDLDCTDSIIPRGPTYDNVSFSHKVCGWQGAKLGHSSVKGREYLNDALGYSYQHVWRNFGILIGFSVFFTVFSLLASQYITPRYDGKTFKLFKKKNYPKRSSKAHDDVPLTDVEFFRFESVMDKAEKNTETDNSLCTEQAVLKSCDTNVVSWKNVNYTVNGKHLLKDVSGYISSGLTALMGESGAGKTTLLNVISQRIEKGVVNGELLVNGCAVKDKNAFKRSVGYVQQQDVHINLLTVWESLEISCRLRGDGDLLYAEKVLDMLKLPREKLFKDLNPAEKKLLSIGVELVTKPSLLLFLDEPTSGLDSEAAVTIIKFLKKLTAQGQAVFCTIHQPSKNIFSYFDNVLLLRKGGECIYFGPRDQIYDYVKRHYSISYDKETENPAELVLDAIGAGANSDSNIGWLSIWNSSKEKKDITDIISQLEDEALADGTNYIELLHETPSYLTQLFIVTKRQYLSITRDRSYMTSKILLNVVAGLFIGFTFWKTKHNIIGLQNLIFTVFMALCISDPLINQLQAKAFEPKEVFITRESKSNTYHWSVLLLSQLLVEIPLVLIGSTFLYLCFYFCLGVDNSPHIAGVFYLNYMLFAIYYLTFGLWLMYMCTDLQTSAVFVAFLFSFTVSFCGVMQPYALFPNFWKFMYRVSPYTYFVDTFVSLLLHERKVICDTSEFAPSQPLAGQTCGQFMKDFIDEHGGYLLNPNAPFVCAYCSYTSGDEFLSIQNMGYHNRWRNFGICCAFVAFNLFAMFSGFYITSVKKLWSVLFEKFSMVLLKKKRFGQKHG

SEQ ID NO: 221 - DNA, 3825 bp, Saccharomyces castelli
atgtcactttctgaatattttacgcctgtggcagatgcttctgttacattcgatggtactcaagtgaaacttgacattcaagataacataactgaatccgacattgaatccggttcctctcaattgcctcaacaactaaatgatctaacatttcaagccaatggaggtgaaatggtgttagttctaggtaagccaacatcatcactgttcaaatctttattccgtagtaaggaatcgttagaatattcaccaaagggttccattaaattcaagacaaatgaatataaatcatacgcgtccaaatgtcctcatcaaattatttacaataacgaacaggatgttcatttcccctttcttacggtccaacaaacaattgatttcgcattaagttgtaaattcgatattacaaaaaatgaacgtatcaaaattagagatgaattactaagagagtttggtttatcgcatgtcatggataccgtggttggtaatgatttcgttcgtggtgtttctggtggtgaacgtaaacgtatttctattattgaaacttttatcgccaatgggtctgtatatttatgggataactctactaagggtcttgattcttctaccgctttggattttctttccatcctaaaaaaaatgactgaagcaactaaatctgtaaatttggtcaagatttctcaggcaagtgataaaattgttaataaattcgataaaatattaatgctctctgattcgtatcaagttttctatggtactgtcgatgaatgtttaatttatttccgtgatactttagctattccaaagaatccaaatgattgtattattgaatatttgacctctattttgaatttacaatttgataatactgattcttccgttgcttctatcagcagttcaactaaggggaaaataacttctcatgttacagatttggctgttactccatcttctgaacttgatttatatcatttgtggattaaatcgaaaaactatcaacattggaaaaatgtgatcaccaaatctagtagcaccatcgaatcaacttctctaaatcccgctgatgtcaccccagttttcaagatttcattaccaactcaaattagatattgtactcaaagagctttccaaagaagtttgggtgataaaatctatttaacagcacaaaccatatcggttattatccaatctttagttattgggtctttattctatgatattccactctctactcttggttcttattcaagaggttcattaactttcttttccattctatttttcactttcctgtctttagctgaaatgcctgctgccttccaaagacaaccagtagtgagtaaacaggcccaacttcatttttactatgcatgggtcgaaacgttggcaactactttcttcgattataccttcaaattacttttggtcattatttttagtatcttactatacttcttagcccatctacaatataatggtgccagatttttcattttcctattgtttttggctgtgtataattttgccatggtctcattattttccttagcgacattaatatctccaactctgtcaattgcaaacttattagctggtatcctattattggccattgctatgtatgcatcttatgtcatttatttgaaggatatgcatccttggttcgtttggattgcatacttaaacccagccagatacgctatggaagcaatcttagcaaatgaattgtataatctaaaattggactgtaaggactccattgttccaaggggccccacatatgataacgtctcatttacaagaaaggcatgtgcttggcaaggtgctacattgggtaacgattatgttagaggaagagattatttatctcaaagtttacactattcatatagccacgtttggagaaattttggaattatcattgctttcctggtcttctttgtcttctgttctctagtttcagcccattatgttaaaccaatattaaataaggaaagaactcctgaatggctcaaaaagttgaagagatcatctctatttcgttctaagaccccattggtcatgagtgattccattgaaatggaaaaggttacatctttctcttccttatcttcagatagtcccattattattgatatgcaaaacaacagtggtaccctttccgaatctgttgaaactcaaaagcatctaatttcttggaagaatataaactacaccataggtgataaaaagttgataaataacgtttctgggttcattggttctggtctaactgctttaatgggtgaatcgggtgctggtaagacaacattattgaatgtattagcccaacgtatcgagagtggtgttgttactggtgaactactgattgatggtaaaccattgacaaatgaaaacgcttttagaagaagtatcgggtttgtccaacaacaagatttacatttagatttgctaactgtcaaggaatcactggaaatatcttgtagattgagaggtgatggtgacatgaagtatttggaaacaatctcatctttgttgaagttgccaatgaacaagctggttgctaagctatctcccactcaaaaaaaattactgtctattggtgttgaattggtcactaaaccttcattgcttttgttcttggatgaacctacttccggtttagattctgaggcagctcttaccatcgtcaagtttttgaaaaagctttctcaacaaggtcaagccattttctgtaccatccatcaacccagtaagagtgtaattagctatttcgataatatctttttactaaagagaggtggtgaaagtgtgtttttcggaccaacaaaggatgcttgtgattatttcatatccaaagacccaagtcttacttttgactctgaatatgataaccccgctgattttattatcgatgttgtcggtggaactactcaaaatgaagaaattgttgaaaaagaaaataattgggcaaatatatgggaaaactcatttgaaaaaggtgctatcgaaaacgatcttttgtcactcgaaagggaggctttaagtgaaaatgtagattattcaacatctgtttgggaacaaccaagctactggaagcaattacttttaatttcgaggagacaatatctatgcacaaagagagataaaacatatgttgccgctaagtatctattaaattcaggagctgggcttttcatcggtttttcattttggaatattaagaaaaatctcagtggtttacaagattgtattttcttctgttttatggcactttgtgtttcatcacctttaattaatcaagttcaggataaggcattgaaatcaaaagaggtctttattgcaagagaatcaaggtcaaatacataccattggtcggtacttttactttctcagattataattgaaatgccgctggctttaacaagttcaacactatttttcttgtgtgcgtacttctgttgtggatttgacaactctccccatattgcaggtgtcttctatttgaactacattctcttttcagcttattatttaacatttggtttgtggttaatatatgctgcaccaaatctacaaacagctgctgttttcgttgcctttttctatagttttactgcttcattctgtggtgttatgcaaccatatggtcttttccctggattttggaaattcatgtatagagtttcaccttacacttatttcatcgatacattcgtgagtttgttacttcatgatagagaggtcgtttgtggtaatatggaattggtgccaggccaaccacctgtgggtcaaacgtgtggccagtttatggcagcttatatc

SEQ ID NO: 222 - protein, 1275 aa, Saccharomyces castelli
MSLSEYFTPVADASVTFDGTQVKLDIQDNITESDIESGSSQLPQQLNDLTFQANGGEMVLVLGKPTSSLFKSLFRSKESLEYSPKGSIKFKTNEYKSYASKCPHQIIYNNEQDVHFPFLTVQQTIDFALSCKFDITKNERIKIRDELLREFGLSHVMDTVVGNDFVRGVSGGERKRISIIETFIANGSVYLWDNSTKGLDSSTALDFLSILKKMTEATKSVNLVKISQASDKIVNKFDKILMLSDSYQVFYGTVDECLIYFRDTLAIPKNPNDCIIEYLTSILNLQFDNTDSSVASISSSTKGKITSHVTDLAVTPSSELDLYHLWIKSKNYQHWKNVITKSSSTIESTSLNPADVTPVFKISLPTQIRYCTQRAFQRSLGDKIYLTAQTISVIIQSLVIGSLFYDIPLSTLGSYSRGSLTFFSILFFTFLSLAEMPAAFQRQPVVSKQAQLHFYYAWVETLATTFFDYTFKLLLVIIFSILLYFLAHLQYNGARFFIFLLFLAVYNFAMVSLFSLATLISPTLSIANLLAGILLLAIAMYASYVIYLKDMHPWFVWIAYLNPARYAMEAILANELYNLKLDCKDSIVPRGPTYDNVSFTRKACAWQGATLGNDYVRGRDYLSQSLHYSYSHVWRNFGIIIAFLVFFVFCSLVSAHYVKPILNKERTPEWLKKLKRSSLFRSKTPLVMSDSIEMEKVTSFSSLSSDSPIIIDMQNNSGTLSESVETQKHLISWKNINYTIGDKKLINNVSGFIGSGLTALMGESGAGKTTLLNVLAQRIESGVVTGELLIDGKPLTNENAFRRSIGFVQQQDLHLDLLTVKESLEISCRLRGDGDMKYLETISSLLKLPMNKLVAKLSPTQKKLLSIGVELVTKPSLLLFLDEPTSGLDSEAALTIVKFLKKLSQQGQAIFCTIHQPSKSVISYFDNIFLLKRGGESVFFGPTKDACDYFISKDPSLTFDSEYDNPADFIIDVVGGTTQNEEIVEKENNWANIWENSFEKGAIENDLLSLEREALSENVDYSTSVWEQPSYWKQLLLISRRQYLCTKRDKTYVAAKYLLNSGAGLFIGFSFWNIKKNLSGLQDCIFFCFMALCVSSPLINQVQDKALKSKEVFIARESRSNTYHWSVLLLSQIIIEMPLALTSSTLFFLCAYFCCGFDNSPHIAGVFYLNYILFSAYYLTFGLWLIYAAPNLQTAAVFVAFFYSFTASFCGVMQPYGLFPGFWKFMYRVSPYTYFIDTFVSLLLHDREVVCGNMELVPGQPPVGQTCGQFMAAYI

SEQ ID NO: 223 - DNA, 2757 bp, Kluyveromyces waltii
atgggagagtcgtttacagacgaacaacaagcttacgagggctttgacgagcccacacaacggcaagtgcgcgagctagctcgcacactgactaatgcttccaaagctaccagcacaggtgtgtcggaagcgtccgggccagccctgaacccggtcttttcgagtatagagggcgatgggtacaatgcgaaactggatcccaactcagagtcgttctcttcatatgcgtggatgcgcaacctgagcaagctcgtggaaaatgatcccgaccattacaagccttactctctgagttgttcctggagtaatctgcgggcgtatggtaactccaccgacgttacttaccagtccacggtggccaacctgccgatgaaggtggccgagatggcctaccgctgcgcgcgcaaagcgcggccagaggacacttttgatattttgaagccgatggatgggttgatcgaacctggtgaactcctcgtggtgctaggacgtcctggctccgggtgttccacgctactaaagtccatctcttccaacactcatggatttcacattgataaaggatctgtgatttcttacgacggtctcactcccaaggagatcaatgcgcattttagaggtgaggtggtgtacaatgccgaagctgatgtacacttcccacacttgacagttttcgaaacgttgaacacagctgcacttctgtcgacacctactaaccgtgtcccgggcgtagatcgtgaagctttcgccaagcacgtgaccgaagcctgcatggccacttatggtcttctacataccagaaacaccaaggtgggtaacgagttggtcagaggtgtctcaggtggagagcgtaaacgtgtgtccattgcagaagtatctatctgtggctctaaatttcaatgttgggacaatgctacccgaggcctagattccgctacggctcttgaattcgtgaaagcgctgcggaccagcgctcaaatgacaagctcatgtgctgcaattgccatctaccaatgctcccaagacgcctacgacctttttgacaaggtgtgtgtgttgtatgaaggttatcaaattttctatggtcctgccactgagggtaaaaagtacttcgaagatatgggttacatctgccccagcagacaaactacagccgattttctcacagctgtcaccaatcctgcggaaagaatagtgaacaaggatatcagtaatgttccttccacagccgtggaaatggagaggtactggaaaaactctgaaaactacagacgtctgcttgccgaaattgatgcctataccaatcaagatcaagacgaaaaacggagacaattgcgggaagcccacaccgctaagcaatctaaacgtgcgagaaactcttctccatacaccgtcagttatggcatgcaagtgaaatacttactaagaagaaactttatgagaatccgcaatagcatgggactcgcgatttttcaagtcgttggtaatggtggaatggctttcatcttaggttctatgttttacaaaattatgaaaaaggatactacggacggtctttactcgcgcgcgggtgctttgttctttgccgtacttttcaacgccttttcgtgtatgctggaaatcttgtcattgtacgaagcgaggcccatttcagaaaagcacaagcggtactcactctacaacccttctgccgacgctttggcctcaatcatctcagagattcctgcgaaaatcatcacttccattgttttcaacattgcactatacttcctctgcaatttcaaaagagaggccggtgcattctttttttacctaatgatgaatttgttggcaacctttgtcatgtctcatatttttagatgtttgggatctgctactaagacctacgctgaatcaatggtgccatcgtccgtgatattgttagccatgtcgatctacactggctttgctatcccaaagactaagatcttgggttgggctaagtggatttggtacatcaatcccttatcttacatctttgaatcactaatggttaacgagtttcacgaccgtcgctttgaatgttccagattcgttcctatcggctcggcgtatgataccgtcactggtgcccagagagtatgctcggcggttggagcagaagcaggctcgaactttgtggatggcgaaaggtacattaatttaagttatggatattatcatgcccacaaatggcgtgggtttgggatcggaatgggcttcgctatctttttcctgggtgtttacctagcccttacggaattgaatgagagtgctaaacaaagtggtgaagttttggttttcaatcattcaactatgaaaaagttgaagaaccagaagaaaagtcttgctgacatagaaaatacagttggagtaaactctgccaatgaaaagaagcttctggaggatagtagtgaagttggtagctcggactctacattaggtaatgcacagctgtccaagtcggaggctattttccattggagaaatgtttgttatgatgtgcccatcaaaggcgataccagaagaattttggatcatgttgacggctgggtaaagccaggtactctaaccgctctcatgggtgcatcgggtgcaggaaaaactacacttctagactgcttagcctccagagtaactaccgggacgattacaggagatatgtttatcaatggctatctacgcgatgcgtcttttgcccgttctatcggttattgccagcaacaagacctacacttg

SEQ ID NO: 224 - protein, 919 aa, Kluyveromyces waltii
MGESFTDEQQAYEGFDEPTQRQVRELARTLTNASKATSTGVSEASGPALNPVFSSIEGDGYNAKLDPNSESFSSYAWMRNLSKLVENDPDHYKPYSLSCSWSNLRAYGNSTDVTYQSTVANLPMKVAEMAYRCARKARPEDTFDILKPMDGLIEPGELLVVLGRPGSGCSTLLKSISSNTHGFHIDKGSVISYDGLTPKEINAHFRGEVVYNAEADVHFPHLTVFETLNTAALLSTPTNRVPGVDREAFAKHVTEACMATYGLLHTRNTKVGNELVRGVSGGERKRVSIAEVSICGSKFQCWDNATRGLDSATALEFVKALRTSAQMTSSCAAIAIYQCSQDAYDLFDKVCVLYEGYQIFYGPATEGKKYFEDMGYICPSRQTTADFLTAVTNPAERIVNKDISNVPSTAVEMERYWKNSENYRRLLAEIDAYTNQDQDEKRRQLREAHTAKQSKRARNSSPYTVSYGMQVKYLLRRNFMRIRNSMGLAIFQVVGNGGMAFILGSMFYKIMKKDTTDGLYSRAGALFFAVLFNAFSCMLEILSLYEARPISEKHKRYSLYNPSADALASIISEIPAKIITSIVFNIALYFLCNFKREAGAFFFYLMMNLLATFVMSHIFRCLGSATKTYAESMVPSSVILLAMSIYTGFAIPKTKILGWAKWIWYINPLSYIFESLMVNEFHDRRFECSRFVPIGSAYDTVTGAQRVCSAVGAEAGSNFVDGERYINLSYGYYHAHKWRGFGIGMGFAIFFLGVYLALTELNESAKQSGEVLVFNHSTMKKLKNQKKSLADIENTVGVNSANEKKLLEDSSEVGSSDSTLGNAQLSKSEAIFHWRNVCYDVPIKGDTRRILDHVDGWVKPGTLTALMGASGAGKTTLLDCLASRVTTGTITGDMFINGYLRDASFARSIGYCQQQDLHL

SEQ ID NO: 225 - DNA, 4461 bp, Kluyveromyces polyspora
atgtctcaagataccgatttctcagtatcttcagatagtcaatctatcgcttctaaagatcaaagcttctctggtgcagatatagccaaccctcataaccgaaatggtgataataacagcagtttacacatttctacccgcagggcttcaatggtcatgtcagatgatgtaaagtctcaagtcgaatgtttggcaaaaactttatcaagacataccacaagagatggcccagttaaagatatattcgaaaatatagaagcctctctagactcagatgccttcgatgcaaaggctatattcacatcgttcgtcaatggtgcaaatgaacaaggtattcatttacgtaaagctggtgtaatactagaagatatctccgccgaaggtactgatgcctctgctttggaaggtcaaacttttggtgatattttatctttgccttacaccatatataaagcaattaaaactaaaagacaaagtaaaatgagaaagattttacaaaacataaactgtttagccgaacctggtgaaatggtattggtattaggtagacctggtgcaggttgttcctcttttctaaaagttaccgctggtgaaatagatcaatttgctggtggtgtcaaaggtgacgtttcctatgatggtatttaccaagatgaaatgatgaaaaattataaatcagatgtcatttataatggtgaattagatgtccatttcccttatctaaccgtcaagcaaactttggatttcgcaattgcctgtaaaactcctgcaaaaagagtcgatgatgtctcgagggctgagtacatagcagctacaagagatctatttgcaaccattttcggtttaagacatacttataatactaaagttggtaacgattttgttagaggtgtctcaggtggtgaaagaaagcgtgtttccattgctgaagccttggctgcaagaggtaccatttactgttgggataacgctactagaggtttagatgcctctactgctttagaatacgcccaagctattagaatcatgaccaacctactagaatcaactgcatttgtcactatttatcaagcttctgaaaatatctacgaatgtttcgataaagttgtagtattgtttgcaggtagacagatttattatggtaaaatcaatgatgcaaaggattattttgctagaatgggttatatatgtccatcaagacagtctactgcagagttcttaacggctttaactgatgtaaacggtttgcatatcatcaaagagggttacgaacataaggtaccaaggactgcagaggaattcgaacatcaatggttaaattctccagaattccaacaattacaacaagatatccaagattataaagatagagtagatgccgaaaaaacaagagaattataccaacagtcaatgaatcaagaaaaatcaaaatactcaagaaagaaatcgtattttaccgtttcatatcctgaacaagttaaactttgtgttcaacgtgggttccaaagaatttacggtgataaaacgtcaactattatcaacactgttgcagctatcgtccaggcttttgtcacagggtccttatattacaattcgccatcaactactaatggtgccttctcaagaggtggtgtgttgtattttgcattattatattattcattgttaggtttagccaatatttcctttgaccatcgtcctattttacaaaagcataaagggtactcactatatcacccttcagcagaagcattagcaagtaccatttctgcaatgcctttcagattaatcggtattacatgtttcctaatcattctattctttttgtctggtttacatagaactgcaagcactttcttcatcgtctacctattcttgattatgtgtgctgaggccattaatggtttattcgaaatgatttcctctggttgtgacaacatcgcccaagctaactctatttgtggtattttaatgttggctatctccatgtactcaacttatatgattcaattgccttcaatgcatccatggttcaaatggatttcttatattttaccaattagatattcttttgaatctatgttaaatgccgaattccatggtagacatatggaatgtggtggtactttggttccaagtggtccaggttatgaaaacgttgctaatgctaatcaagtttgtgctttcgtaggttccactccaggccaatcttgggttttaggtgataactatttgagattacagtacacttatgaatataagcacacttggagaaattttggtatcatgtggtgtttcctaattggttatgttggtttgaaagctcttattactgaattcaaaagacctgttatttctggtggtgacgctttaatcttcaagaagggttacaagagatctactatttcttcagatgaagaatctgctgatagttacaacgttgctgacgttaaagaaaaatattctactggtgaaagcttcagtgatgagcacgataatattttcgaaggtttgaaaagtactggtatatttttatggaataaggtctgttttactattccatatgatggtggccaacgtatgttattagatcatgtttctggttactgtataccaggtactttaactgctttaatgggtgaatctggtgctggtaagactactttattgaatactttggctcaaagaaatgtcggtatcattaccggtgatatgttggttaacggtcgtccaattaatgcaagttttgaaagacgtactggttatgttcaacaacaagatgttcacattgctgaattaaccgttagagaatcattacaattttctgctcgtatgcgtcgtgcccaaagtattcctgattctgaaaagatggcatatgttgaaaagatcattcgtatcttagatatggaagaatatgctgaagctttagttggtgcagttggccgtggtttaaatgttgaacaaagaaagaaattatctatcggtgttgaattggttgctaaaccagatctattgttgtttttagatgaacctacctctggtttggattctcagtcttcttggtctattgttcaattattaagaaagttagccgaagctggtcaatctattttgtgtaccatccatcaaccttctgccactctatttgaacaatttgatagactattacttttaaagaagggtggtcaaaccgtctacttcggtgacattggtcaaaattcaactactttattggaatattttgaaagaaatggtgctagaaagtgcgatgctaaggaaaaccctgctgaatatatcttggaagctatcggtgccggtgcaactgcatcagtcaatgaagattggcatcaaatctggaagaactctccagaacatactgaaactgaacaaagaattgaagaaatgataagagatttaactgcaaaaggtgctgattcagcagatgatgacaattctaaatacgctacatcctacttctatcaattcagatacgtctggattagaactgccacaactttgtggagagatttgccttacatcatgtctaaaatgatgctgaacattactgctggtcttttcattggttttactttctatgatgtcggtaagacttttactgggttacagaatgctttatttgcaaccttcatggctattgttttgtctgctccttcgatgaatcaaattcaagctcgtgccattgcatcaagagaattatttgaagttagagaatcaaaatctaatatgttccattggtcattggtcatggttacacaatacttatctgaaatcccataccatttatttttctcaacgttattctttgtctcattgtatttcccattaagaattttctttgaagcttcaagatctgctgtgttctatttgaactattgtatcttattccaattattttatgtcgctctaggtttaatggttctgtacatgtctcctgatttaccatccgctaatattttaatgggtttgaccttgtcattcttaatttctttctgtggtgttactcaaccggaatcattaatgcctggtttctggactttcatgtggaaggcttctccatacacatatttcgttcaaaacttggttggtattatgttacacgaaaaaccagttatttgctcaaagaaagaattgaattattttgctcctccatcaggtatgacatgtggggaatatatggaaccattcttaaaccgctcaactggttatattgtcgatccttcttctactaccgaatgtgcatactgtatctacaatgtcggtgacgattatttgacacacatcagttccagctatagctatctatggagaaatttcggtttttactgggcttacattggtttcaatatttgtgctatgatcggggtttattacattttccatgttagaaagatttcaatgatcaaaccaggaaatatcttaaagaagttcaagaagaattaa

SEQ ID NO: 226 - protein, 1486 aa, Kluyveromyces polyspora
MSQDTDFSVSSDSQSIASKDQSFSGADIANPHNRNGDNNSSLHISTRRASMVMSDDVKSQVECLAKTLSRHTTRDGPVKDIFENIEASLDSDAFDAKAIFTSFVNGANEQGIHLRKAGVILEDISAEGTDASALEGQTFGDILSLPYTIYKAIKTKRQSKMRKILQNINCLAEPGEMVLVLGRPGAGCSSFLKVTAGEIDQFAGGVKGDVSYDGIYQDEMMKNYKSDVIYNGELDVHFPYLTVKQTLDFAIACKTPAKRVDDVSRAEYIAATRDLFATIFGLRHTYNTKVGNDFVRGVSGGERKRVSIAEALAARGTIYCWDNATRGLDASTALEYAQAIRIMTNLLESTAFVTIYQASENIYECFDKVVVLFAGRQIYYGKINDAKDYFARMGYICPSRQSTAEFLTALTDVNGLHIIKEGYEHKVPRTAEEFEHQWLNSPEFQQLQQDIQDYKDRVDAEKTRELYQQSMNQEKSKYSRKKSYFTVSYPEQVKLCVQRGFQRIYGDKTSTIINTVAAIVQAFVTGSLYYNSPSTTNGAFSRGGVLYFALLYYSLLGLANISFDHRPILQKHKGYSLYHPSAEALASTISAMPFRLIGITCFLIILFFLSGLHRTASTFFIVYLFLIMCAEAINGLFEMISSGCDNIAQANSICGILMLAISMYSTYMIQLPSMHPWFKWISYILPIRYSFESMLNAEFHGRHMECGGTLVPSGPGYENVANANQVCAFVGSTPGQSWVLGDNYLRLQYTYEYKHTWRNFGIMWCFLIGYVGLKALITEFKRPVISGGDALIFKKGYKRSTISSDEESADSYNVADVKEKYSTGESFSDEHDNIFEGLKSTGIFLWNKVCFTIPYDGGQRMLLDHVSGYCIPGTLTALMGESGAGKTTLLNTLAQRNVGIITGDMLVNGRPINASFERRTGYVQQQDVHIAELTVRESLQFSARMRRAQSIPDSEKMAYVEKIIRILDMEEYAEALVGAVGRGLNVEQRKKLSIGVELVAKPDLLLFLDEPTSGLDSQSSWSIVQLLRKLAEAGQSILCTIHQPSATLFEQFDRLLLLKKGGQTVYFGDIGQNSTTLLEYFERNGARKCDAKENPAEYILEAIGAGATASVNEDWHQIWKNSPEHTETEQRIEEMIRDLTAKGADSADDDNSKYATSYFYQFRYVWIRTATTLWRDLPYIMSKMMLNITAGLFIGFTFYDVGKTFTGLQNALFATFMAIVLSAPSMNQIQARAIASRELFEVRESKSNMFHWSLVMVTQYLSEIPYHLFFSTLFFVSLYFPLRIFFEASRSAVFYLNYCILFQLFYVALGLMVLYMSPDLPSANILMGLTLSFLISFCGVTQPESLMPGFWTFMWKASPYTYFVQNLVGIMLHEKPVICSKKELNYFAPPSGMTCGEYMEPFLNRSTGYIVDPSSTTECAYCIYNVGDDYLTHISSSYSYLWRNFGFYWAYIGFNICAMIGVYYIFHVRKISMIKPGNILKKFKKN

SEQ ID NO: 227 - DNA, 4185 bp, Saccharomyces cerevisiae
atgtcaatttcaaagtacttcactcccgttgctgacgggtcactcactttcaatggcgcgaacattcaatttggcgccgatgctcaaggcgagtcaaaaaagagttatgacgctgaggacagcatgccgaatccggcaaatcaactaaatgacataaccttccaagcagaggctggtgaaatggttttggttttgggttatcccacatccactctatttaagactttgtttcatggtaaaactagtttgtcatactctcctccaggctcgattaaatttaaaaataatgagtttaagagcttttccgaaaaatgtccccaccaaatcatttacaataatgaacaagatgtgcatttcccatttctaacggtagaacaaacaattgattttgccttgagttgtaagttcgatattccaaaaggtgagcgcgatcaaataagaaatgaacttctaagagaattcggcctgtctcatgtattgaaaactattgtaggaaatgattttttccgtggtgtttctggtggtgagcgtaaacgtatttctattattgaaacgtttattgctaatggttccgtttatctatgggataattctactaaaggtttagattccgccacagctctcgattttttggaaattcttagaaaaatggcaaaagctactcgttctgtaaacttagtcagaatttcccaggcaagtgataaaattgttgataagtttgacaagattcttatgctatccgattcctaccagcttttctatggtacggtcgatgagtgtttgacttattttcgtgacactttaggtattgagaaagatcctaacgattgtattattgaatatctgacctctatcttaaattttcagttcaaaaataaaaatttggggaatttatcaaattcatcatctgctagcgttctcaaaaccgcaacaggggaagtcactaagtatacttataattctgatttcgatttatatgatcaatggaaacattcttcgtactatagaaatataaagcagcaaatccaggggtcttcaattgatgactccattaaggaagtggatccctctgatgtctcacctatttttaatattccgttgaagaaacaattattattttgcacaaaaagagcttttcaacgaagtttgggtgataaagcttatatgacggcacaatttatttctgtcgttattcaatctttggtcattggttcactgttttacgaaattccgttgactaccattggttcatactcaagaggttctttaacctttttctccattcttttcttcacttttctttctcttgcagatatgcctattgccttccaaagacaacccgtcgttaaaaagcaatcccaacttcacttctatactaactgggttgaaaccctttcaacaacagtgttcgactactgctttaaactttgtttggtaattgtattcagtatcatcctatacttccttgctcacctgcaatacaaggctgcaagatttttcattttcctcctgttcctttccttttacaatttctgtatggtgtccttattcgctttgacgacactagttgctccaaccatttcagttgcaaatttatttgcaggtattctgctactagctatagcaatgtatgcttcttacgtcatctacctgaaaaatatgcatccttggtttgtatggattgcttatctaaatcctgcaatgtacgctatggaggcaatactgtctaatgagctttacaatttgaagctggattgtagtgagacaattgttccaagaggtcctacttacaacgatgttccattttcccataaggcctgtgcttggcaaggtgctactctgggtaatgattacgttagaggccgtgattacttgaagcaaggtttatcctacacgtatcatcatgtgtggagaaactttggtattatcattggtttcctagtattctttattgcctgtactctgtttgcatctcaatatattaagccttatttcaataaggatgaaatagagcgcaacaatagtcgtttgacaagatggctaccatttttgaataaaaagagaggtaccaggtcctctgcaagaaatgacagtaagtatgttggtatcccaaagtcgcactccgtttcgtcttcctcgtctagcctgtcggctgttccatatcagatatcaccctcaaataaggaaatggctctaaacgattataacgagcaacctatcacggaaacagtagagactcaaaagcatatcatctcttggaaaaatatcaactacacagttggtacaaagaaactgattaataatgcatccggtttcatcagttctggtttgaccgccttaatgggtgagtccggtgcaggtaaaactactttgctgaatgtcttatcacaaagagttgagacaggtgttgttagcggcgaaattttgatcgatggccacccattgacagatgaggacgcgtttaagagaagtattggttttgttcaacaacaggatttgcatctagatttgctgtctgtgaaagaatctctggaaatatcatgtcttttgagaggtgatggtgacagggcatacttagacactgtttcaaatttactgaaattgccatctgacattttagtcgctgatttaaacccgactcaaaggaagcttttatctatcggtgttgaacttgttactaagccttcacttttattattcctagacgaaccaacctctgggctggacgctgaggctgcactaacaatcgtcaaatttttaaaacaactttctttacagggtcaggctattttttgtaccattcatcagcctagtaaaagtgtcatcagccattttgacaatattttcttattgaaaaggggtggtgaatgtgtcttctttggaccaatggacgatgcctgcggctatttcatgtctcatgacaacacgctcgtttacgataaagaacatgataaccctgcagatttcgtcattgatgcagtaggtaacagtaactcctcggcagggaaagatacagcggaggaagctcttactttgaacaaagaagccatagattggagtgcattatgggaatcttctgtagaaaagaaactagttaaaaaagaaacagctaggttagaagatgatgctcgtgcgtctggtgttgattacacaacctcattgtggaagcagccttcctacttacagcaattagctcttattacaagaagacaatatatttgtacgaaaagagacatgacttatgtcatggccaagtactgtttgaatggtggcgctggtttgtttatcggtttctcattttggcacattaagcataatattatcggtttgcaggatagtatcttcttctgtttcatggctctttgtgtttcatctccattgatcaatcaaattcaggacaaagccttgaaaacaaaggaagtttatgttgctagggaggcgagatctaacacttatcactggactgttcttcttttgtcacagtcaattattgaactaccactggcacttacaagttccacactatttttcgtctgtgcctttttctcttgtggatttaacaacgctggctggagtgccggtgttttctttttaaactatatgcttttcgctgcttattactcgactcttggtttatggctgatctatactgctcctaatctacaaactgctgctgtttttgttgcgtttatttacagttttacagcatcattctgtggtgttatgcaaccatactctttgtttccaactttttggaaattcatgtacagggtttcgccatacacatattttgtggaaacttttgttagtattctattgcataactgggaaatcaagtgtgacatgtcggagatggttcctggtcaacctctgacggggcaatcttgtggccaatttatggaagctttcatagaagaatacggtggctatctacataataagaacactttcacagtctgcgcttattgtacgtacactgttggcgatgacttcctgaaaaatgagaatatgagttacgaccacgtttggaggaactttggtattgaatgggcttttgttggtttcaatttctttgcgatgtttgctggttactacttaacttacgtggcaagaatatggccaaaggtctttaaaattatcaccaaagtaattccacacagagggaagaagcctgtacagaactaa

SEQ ID NO: 228 - protein, 1394 aa, Saccharomyces cerevisiae
MSISKYFTPVADGSLTFNGANIQFGADAQGESKKSYDAEDSMPNPANQLNDITFQAEAGEMVLVLGYPTSTLFKTLFHGKTSLSYSPPGSIKFKNNEFKSFSEKCPHQIIYNNEQDVHFPFLTVEQTIDFALSCKFDIPKGERDQIRNELLREFGLSHVLKTIVGNDFFRGVSGGERKRISIIETFIANGSVYLWDNSTKGLDSATALDFLEILRKMAKATRSVNLVRISQASDKIVDKFDKILMLSDSYQLFYGTVDECLTYFRDTLGIEKDPNDCIIEYLTSILNFQFKNKNLGNLSNSSSASVLKTATGEVTKYTYNSDFDLYDQWKHSSYYRNIKQQIQGSSIDDSIKEVDPSDVSPIFNIPLKKQLLFCTKRAFQRSLGDKAYMTAQFISVVIQSLVIGSLFYEIPLTTIGSYSRGSLTFFSILFFTFLSLADMPIAFQRQPVVKKQSQLHFYTNWVETLSTTVFDYCFKLCLVIVFSIILYFLAHLQYKAARFFIFLLFLSFYNFCMVSLFALTTLVAPTISVANLFAGILLLAIAMYASYVIYLKNMHPWFVWIAYLNPAMYAMEAILSNELYNLKLDCSETIVPRGPTYNDVPFSHKACAWQGATLGNDYVRGRDYLKQGLSYTYHHVWRNFGIIIGFLVFFIACTLFASQYIKPYFNKDEIERNNSRLTRWLPFLNKKRGTRSSARNDSKYVGIPKSHSVSSSSSSLSAVPYQISPSNKEMALNDYNEQPITETVETQKHIISWKNINYTVGTKKLINNASGFISSGLTALMGESGAGKTTLLNVLSQRVETGVVSGEILIDGHPLTDEDAFKRSIGFVQQQDLHLDLLSVKESLEISCLLRGDGDRAYLDTVSNLLKLPSDILVADLNPTQRKLLSIGVELVTKPSLLLFLDEPTSGLDAEAALTIVKFLKQLSLQGQAIFCTIHQPSKSVISHFDNIFLLKRGGECVFFGPMDDACGYFMSHDNTLVYDKEHDNPADFVIDAVGNSNSSAGKDTAEEALTLNKEAIDWSALWESSVEKKLVKKETARLEDDARASGVDYTTSLWKQPSYLQQLALITRRQYICTKRDMTYVMAKYCLNGGAGLFIGFSFWHIKHNIIGLQDSIFFCFMALCVSSPLINQIQDKALKTKEVYVAREARSNTYHWTVLLLSQSIIELPLALTSSTLFFVCAFFSCGFNNAGWSAGVFFLNYMLFAAYYSTLGLWLIYTAPNLQTAAVFVAFIYSFTASFCGVMQPYSLFPTFWKFMYRVSPYTYFVETFVSILLHNWEIKCDMSEMVPGQPLTGQSCGQFMEAFIEEYGGYLHNKNTFTVCAYCTYTVGDDFLKNENMSYDHVWRNFGIEWAFVGFNFFAMFAGYYLTYVARIWPKVFKIITKVIPHRGKKPVQN

SEQ ID NO: 229 - DNA, 1800 bp, Saccharomyces castelli
atgcagtttaaaaaacctttgggaggtagaaaagaacctcaactggaacagtatgcattaaaaaacgaggaagatttgtccgctcgttcaagttttgccaattcaattaacgacagtgttaattctggagatggggacccaatacaattacatgatccacatcaacttgaacatccagcgccaataccaaacgaaaattcactagttagaacaaaatcgacaaatgatgagccggatgtcacaacggctccatactctcgatttggccctagagaaaaaatgatccttgtagtgcaatgtgcatttactggtttcttttcatctattgctagttcaatctattatcctgtcttaacagtcattgaaaaattatttgacattagtgaagaatctgttaacattacagttgttgtttattttatatttcaaggcctttcaccaagtataatgggtgggttagctgactcgctggggagacgtccagtggttttattttccgtagcagtgtacttctgtgcctgtgtgggattagcttgtgctcaacatatccacaaattattgtttagatgtttgcaagcagctggtatatcacctgtgatcgctatcaatagtggtattatgggtgatggtcaacaacggcagaaaagaggggttatgtgcaacggcgatctgatatctcgccctgtggtggaattctggttatgtgggttatgtctccgggtttcaagttcttggaattcctttggtgctttaattggtgctggtatttctagtacatggagttggagagcaattttttggtttttagccattggttctgggatttgtttactagcatcatttattgtcttaccagagacgaagagaacgattgctggtaatgggtcaattattccaaaatccagatttaatagatcaccaagtttgcttttcccacctttgaggaaaagattacatttagataatcctgatttggagactttagaacccaaagtgaaaataagtttcctagcgccacttggtatcttaaagatacctgaagtggatattgtattacttgttgctggcttacaatatatgactactcatcaaacggcattatcaaccgtattgagtaaaaaataccatttaacagtggccaaaattgggctatgttatttacctactggtatttgtactttaattagtgtcgtcacatcgggtaggtatctaaattggagttatagacgcaaaataattaagcatagacaatggaaaaaggagcaggaaaccatattgttagaagaatataataatgatatggaacaagtcaaggaaatcatggataatgatcccaagtatgttttcaatattttcaaagctagaattcaacctgcctttggtactttaattttaagtggtctgggattttgtgcatacggttggtgtatcagtgttaaggctcccttagcggccgttcttgttacaagtgggtttgggtcattattttccaattgtatattgacaatgtcaacaactttagctgtagatttgttcccatcaaaagcagccactgctactagttgtctgaatttattcagatgctccttagcagctatctttattgcttgtttgagtaagatggtggataggatgacctatggtggtgttttcacatttttagcagctttaactacctcttcgtctcttttactgctaataccagtaagtagaggtaaagagttggctttgaagagaagacaacaggaaaattctttgttacagaaaaaacccactccagaaaagcatttcagtgtttaa

SEQ ID NO: 230 - protein, 599 aa, Saccharomyces castelli
MQFKKPLGGRKEPQLEQYALKNEEDLSARSSFANSINDSVNSGDGDPIQLHDPHQLEHPAPIPNENSLVRTKSTNDEPDVTTAPYSRFGPREKMILVVQCAFTGFFSSIASSIYYPVLTVIEKLFDISEESVNITVVVYFIFQGLSPSIMGGLADSLGRRPVVLFSVAVYFCACVGLACAQHIHKLLFRCLQAAGISPVIAINSGIMGDGQQRQKRGVMCNGDLISRPVVEFWLCGLCLRVSSSWNSFGALIGAGISSTWSWRAIFWFLAIGSGICLLASFIVLPETKRTIAGNGSIIPKSRFNRSPSLLFPPLRKRLHLDNPDLETLEPKVKISFLAPLGILKIPEVDIVLLVAGLQYMTTHQTALSTVLSKKYHLTVAKIGLCYLPTGICTLISVVTSGRYLNWSYRRKIIKHRQWKKEQETILLEEYNNDMEQVKEIMDNDPKYVFNIFKARIQPAFGTLILSGLGFCAYGWCISVKAPLAAVLVTSGFGSLFSNCILTMSTTLAVDLFPSKAATATSCLNLFRCSLAAIFIACLSKMVDRMTYGGVFTFLAALTTSSSLLLLIPVSRGKELALKRRQQENSLLQKKPTPEKHFSV

SEQ ID NO: 231 - DNA, 1689 bp, Saccharomyces bayanus
atgtcacgaaataacagtatatattcagaggacatcgaaatgtaccccacgcataatgagcagcacttgacgagggagtacacaagatcccatgatgaggtgaaaagtggaaagctcaattccgaagacggatacgtcaacattcatgggactttgtctaaagccaccacaagggaaatagaaggcgacttggaatccgagacctcttcccactccggcgacgacaaactggatccctcgctaccaataaccacagaaacgggcgcgccatatacgttgctaagttacggtcagaaatgggggatggtagcagtcctaaccatgtgcgggttttggtcctccctggggtctccaatctattatcccgccttaagacagttggagaaggagttcaatgtagacgaaaatatgattaacattaccgtggttgtgtatctaatgtttcaaggtatagcgcccacggtttgcggtgggctagcagattgttttggacgtagaccaatcattcttggcggcatgctagtgtatgttgtggcatccgttggcttagcatgtgctccatcatacggtgttatcatctttttgagatgtgttcagagtattggtatttctcctacaatcgctattagttccggggttgtcggagatttcactttaaagcatgaaagaggtacttttgtcggtgccacatctgggtttgtcttacttggccaatgtttcggtagtcttatcggtgctgtcctgacagcaaggtgggattggagatctattttctggtttttaaccattggttgtggtacttgtttcctgatagcgttctttattctaccagaaacgaagaggaccatcgcaggtaatctttccgtcagacctaaaagatttattaacagagccccaattttccttttgggccctgtcaggagaagattcaagtatgacaatcccgattatgagacattggatcccactattcccaaactagacttgacatctgcaatgaaaattcttgcactgccagaaattattctggctttgttcccatcagggctgttatttgccatgtggacattgatgctttcgtctatttcatcggggttatcagtggggccatataattatcgtttagtgattatcggtgtttgttacctacctggtggtattggtggtttattgggttctttactcacaggtagagtcattgacatgtactttaagaaaaaagtgaaaaaatttgaagaagacaaggccaacgggttaattccacaagatgctgaaatcaacatgttcagggtccgcttggtatgccttctacctcaaaatttcttagctgttatagcataccttttgttcggctggagtatcgacaaaggatggagaatcgagtccgttttaattacttcatttgtttgttcatactgtgccatgagtacattatcaacatcaaccacgttattggtggatttatatccaaccaaatcatctacagccagtagttgtttcaactttgttagatgcagtttgagtacgatcttcatggggtgttttgccaaaatgaaagcctcaatgactgtgggtggtaccttcacattcttatgtgcattggtgtttttctttaacttcctaatgttcattccaatgaaatacggtatgaagtggagagatgacagattgttgaaacgtcagacataa

SEQ ID NO: 232 - protein, 562 aa, Saccharomyces bayanus
MSRNNSIYSEDIEMYPTHNEQHLTREYTRSHDEVKSGKLNSEDGYVNIHGTLSKATTREIEGDLESETSSHSGDDKLDPSLPITTETGAPYTLLSYGQKWGMVAVLTMCGFWSSLGSPIYYPALRQLEKEFNVDENMINITVVVYLMFQGIAPTVCGGLADCFGRRPIILGGMLVYVVASVGLACAPSYGVIIFLRCVQSIGISPTIAISSGVVGDFTLKHERGTFVGATSGFVLLGQCFGSLIGAVLTARWDWRSIFWFLTIGCGTCFLIAFFILPETKRTIAGNLSVRPKRFINRAPIFLLGPVRRRFKYDNPDYETLDPTIPKLDLTSAMKILALPEIILALFPSGLLFAMWTLMLSSISSGLSVGPYNYRLVIIGVCYLPGGIGGLLGSLLTGRVIDMYFKKKVKKFEEDKANGLIPQDAEINMFRVRLVCLLPQNFLAVIAYLLFGWSIDKGWRIESVLITSFVCSYCAMSTLSTSTTLLVDLYPTKSSTASSCFNFVRCSLSTIFMGCFAKMKASMTVGGTFTFLCALVFFFNFLMFIPMKYGMKWRDDRLLKRQT

SEQ ID NO: 233 - DNA, 1722 bp, Kluyveromyces polyspora
atgacggaatatcagaggccaagggatagtctagacagcgccaatatatacagtgagcaaagcagcacgacttctctcgagaagcaattagagccttatggagtaggtaaagaagttaaagattacacatacggtgttatcaatggtaatggcgacggtatctataaagtggacggtacattgtcaagaactcaaactcgtgaagtagaggaatctgatctggaatcagccgatgatgtcaaaactataaaggacagccaagaatacgtagcaccatatactttattcagctattcacaaaagtggattatggtggggttattaactatgtgtgggttctggtcttcattaggttcgccaatttactatccagctttaagacaattggaaaaacaattcgatattgatgaaaatttagttaacgtcactgtggtggtttacttattatttcaaggtatttcaccaaccgtctgtggcggtttagccgacatatatgggcgtagacctgttatattattcggtatgttagtttacattgttgcatctatcgccttggcttgcgctaactcatatggtgttattattttcttaagatgtcttcagagttgtggtatttctccaatcattgcaattagttcaggatgcgttggtgatttcacaatgaaagcagaaagaggtacatttgttggtgctgtatcaggtttagtcttgttgggtcaagcatttggttctttgattggtgcagcattagcagcagcttgggattggagagcaattttctggttcctggcaattggtgcagggtgttgtctatttgtaggtattttggttttgccagaaacaaagagaacaattgtgggtaatatgtctataaaacctaaaaacatcatcaatagagcaccaattttcttattaaaaagcttccagaagagattcaaatatgataatccagattatgaaaccttggatcaaaacaagccaaagctaaaccttttagcgccattcaccatcatctgtcaaccggaaattgtattatcactacttccaggtggtttacaatttgcattatggacattaatgttatcatcaatttcttcagaattagctattgaaccttataattataaactgattattattggtgtatgttatttaccagctggtatgggtggtttacttggatcgttgattacaggtagagtaattgatatctattataaaaagagtttaaaaaaattcgatgcaatgaaggaagccaaagaaattccagaagataaacaattcaatattttcaaagcacgtctactaccagcattaccacagaatttcattgctgtcgctgcatttatattatttggttggtgtgtggataagggcttaaaagtcgaaagtatattaatcgtttcattttttggttcatattgtgcaatgagtacattatccacatctagcacattgttggttgatctttatccagggaagtcgtctactgctacaagttgtttcaatttcatcagatgtagtttaagtgctatgtttatgggttgttttgcgaaaatgaaaggttccatcacagttggtggtacattcacattaattgttggttttcttttcgttgcaaatttcttagtcatgatcccagtaatgtacggtatggaatggagacaaaaaagagctaataaagctgaacttaaggcacaaagcacaatggaagccaattaa

SEQ ID NO: 234 - protein, 573 aa, Kluyveromyces polyspora
MTEYQRPRDSLDSANIYSEQSSTTSLEKQLEPYGVGKEVKDYTYGVINGNGDGIYKVDGTLSRTQTREVEESDLESADDVKTIKDSQEYVAPYTLFSYSQKWIMVGLLTMCGFWSSLGSPIYYPALRQLEKQFDIDENLVNVTVVVYLLFQGISPTVCGGLADIYGRRPVILFGMLVYIVASIALACANSYGVIIFLRCLQSCGISPIIAISSGCVGDFTMKAERGTFVGAVSGLVLLGQAFGSLIGAALAAAWDWRAIFWFLAIGAGCCLFVGILVLPETKRTIVGNMSIKPKNIINRAPIFLLKSFQKRFKYDNPDYETLDQNKPKLNLLAPFTIICQPEIVLSLLPGGLQFALWTLMLSSISSELAIEPYNYKLIIIGVCYLPAGMGGLLGSLITGRVIDIYYKKSLKKFDAMKEAKEIPEDKQFNIFKARLLPALPQNFIAVAAFILFGWCVDKGLKVESILIVSFFGSYCAMSTLSTSSTLLVDLYPGKSSTATSCFNFIRCSLSAMFMGCFAKMKGSITVGGTFTLIVGFLFVANFLVMIPVMYGMEWRQKRANKAELKAQSTMEAN

SEQ ID NO: 235 - DNA, 1698 bp, Saccharomyces kluyveri
atgctctcaaaaagaatgatagacacgagagacgattcgtccatactgagtgacgacacattcaacgaaaaccagaatggtacagaacaagaagtcaaagaactggtgcagggcaaaaacaattttaaagggctgaaaggcgataacgtaaactctctatctaggactacaaccagagaggttcgcgctacaccttccgagtccgatctagatacatatactgacgcagagactcctgataaagtctcatgcgagacaccatacacgttaatgacacatggacagaaatggtttatggttgcattattgacatccggagggttttggtcatcattaggctctccgatctattatcctgctttaaagcagctggagcaagttttcaacatcaacgaagaaatggttaacattacggtggttgtctactttatcttccaaggtgtagcgcctactatcagtggtggtttggctgatgtttatggccgtagacctattattttagccggtatgctgatatacgttgtcgcttccatcggtcttgcatgctctaactcatacggtgtgattgtgtttttgagatgtgttcagagtgcaggtatttcgcctcttattgccatcagttccggtgttgttggtgatttcactacaaaatccgagcgtggtagttttgtcggggcagtatctgggttcgccttgatgggccaagcattcggttccctgatcggtgctggtttaacagctgcttacgattggagagcaattttctggtttttgactataggttgtggcacatgctttgtaataaatttctttttacttccagaaacgaaaagaaccattaccggtaatttgtccatcaaaccaaagaggatgatcaacagagctccgattcttgctctaccttacttccagaggagactcaaatacgacaatccagactacgacagtttagaccacagtgaggtcaaaatagatttgatctcggctttgaagatcattgcacatccagaaatcatcatgtccctaatgccagcaggcttacagtttgcattgtggactttgacactgacgtcaatctcatcccaattggcagaagctccatacaactattccttgacgatcattggtatttgttatctgccagccggtatctctggtctaattgggtctttttgtacaggcaaagtcatcgacatatactacaagagcgctcttcggaaattccaacaaagacaggagcagggtttaatcgcaccagatgccaggtttaacattttaaaagcacgtctaatcaccgctctaccacaaaactttgtctctgtagtggcgttcacaatattcggttggagtgttcaaaaaggttggcatattgctgttcctctggttacgtctggtatcggttcattttgcgcaatgagtactctatccacatccagtactttgcttgtggacttgtatccaagtaaatcttcaactgccaccagttgttacaatttcatcagatgttcgttgagcgccatattcatggcatgttttgccaaaatgaaggcctctatgactgtaggcggtacttttacatttattagcgggttagttttcattggtaatttcgtcacgttgattcctctaaactacggtatggaatggaggtacaagagggctctaaaggctgaactgaaagccatgggaaaggaatag

SEQ ID NO: 236 - protein, 565 aa, Saccharomyces kluyveri
MLSKRMIDTRDDSSILSDDTFNENQNGTEQEVKELVQGKNNFKGLKGDNVNSLSRTTTREVRATPSESDLDTYTDAETPDKVSCETPYTLMTHGQKWFMVALLTSGGFWSSLGSPIYYPALKQLEQVFNINEEMVNITVVVYFIFQGVAPTISGGLADVYGRRPIILAGMLIYVVASIGLACSNSYGVIVFLRCVQSAGISPLIAISSGVVGDFTTKSERGSFVGAVSGFALMGQAFGSLIGAGLTAAYDWRAIFWFLTIGCGTCFVINFFLLPETKRTITGNLSIKPKRMINRAPILALPYFQRRLKYDNPDYDSLDHSEVKIDLISALKIIAHPEIIMSLMPAGLQFALWTLTLTSISSQLAEAPYNYSLTIIGICYLPAGISGLIGSFCTGKVIDIYYKSALRKFQQRQEQGLIAPDARFNILKARLITALPQNFVSVVAFTIFGWSVQKGWHIAVPLVTSGIGSFCAMSTLSTSSTLLVDLYPSKSSTATSCYNFIRCSLSAIFMACFAKMKASMTVGGTFTFISGLVFIGNFVTLIPLNYGMEWRYKRALKAELKAMGKE

SEQ ID NO: 237 - DNA, 1809 bp, Kluyveromyces lactis
atggacgatgaagaatctcacgtttcagtgagttcatataacaatatggatgacgatgatgacgaggtattggaagaacatgctaccgaacctcagaacttgtatatggaacatgctgagaaaatacaaaaaactgataacagactagacgtgacggattcaaaccgccagctttccttactgaactctaccaaatctgagacaaactttgacggcattccttacacaagattctctaagcatgacaaacttttcctagtggtaatatgtgcgttgagtggattttattcgaccatcgctcaaacgatttacttcccagcattgagtattattgaaaaagaatttaacgtcagcgtgagtttggttaatgtaaccgttgtagtgtattcactatgccaaggtatcttccccgtgattatgggaggtttggcggatagattgggacgtcggcctgtggctatgttttgtattatggtttatttttgtgcttgtataggaatcgcatgctgtcgaacatttggagagatgattttcttaagatgtttgcaaggtggtggtatatcgcctataattgcaattaataacggtttaatgggagatatcaccgtaaaatcggaacgaggtggttatgtcggattgacaagtggtttccaagtgttgggaagtgcattaggtggtctacttggtgctttattcactgcaagatggggctggagatcgatcttttggtttttgtctgctggttccggtgtaactttgctgtttgtggttactgctttacctgaaactaagagatctattgtaggaaacggctcaatcaaaccacctcatcttattagcaggtctgtcctcttgggtgcaccatattataaaaaaaaattgcatttagacaatccagattatgaaacgaagactgagaatgcctcatatgatccattagctcctttcaaaatcatggtaagaccggaacttatatcgttgttggccgttcagggtttacaatttacaacctggatatgtcacatgacgaccctttctgaacatctaaacaaggattatggcctaccgatggtaattatcggtgtttgtttacctgccggtttgtgtacgctaacgagtgttgttttagctggtaaattcttaaactggaattatagaagaaggttcgcgaaacataagaagttcatccaaaacgaaaagaaaatactcttagaagagaatgattacgattcacaattggttagagatatcatagaccaagatattcagcataagtttgatttatacaagaccagattagattatgcttatgtgcctatcataatttcaaatgcaggatttatcatttttggctggtgtattggaaccaaacagcatttagcagtcattttagtgatgtcaggtctcgcatcattgatgtgtaactgtatgatctcaataagcaatacgttggttgtggatttgtatcccgaaagagcctccactgcagccggttgtgtcaacttcgttcgctgtatcttcacagctattatggttgcagcgttagctaaaatgaattcatcaatgaccgttggtggtacgttcacctttttaacttgtttggcatgggtctgttctatgttactaatagtcccaatgaaatatggcttaaggctgcaattggcaagagaaaagaaacaaagtcagaagacactcggaagagagaatatagacgaaaataacatacatcctgaaatgtctgaagaagagagagagttgtgtgatcttcgtcgctctgctacagccctttctaatttatctgcagtgtaa

SEQ ID NO: 238 - protein, 602 aa, Kluyveromyces lactis
MDDEESHVSVSSYNNMDDDDDEVLEEHATEPQNLYMEHAEKIQKTDNRLDVTDSNRQLSLLNSTKSETNFDGIPYTRFSKHDKLFLVVICALSGFYSTIAQTIYFPALSIIEKEFNVSVSLVNVTVVVYSLCQGIFPVIMGGLADRLGRRPVAMFCIMVYFCACIGIACCRTFGEMIFLRCLQGGGISPIIAINNGLMGDITVKSERGGYVGLTSGFQVLGSALGGLLGALFTARWGWRSIFWFLSAGSGVTLLFVVTALPETKRSIVGNGSIKPPHLISRSVLLGAPYYKKKLHLDNPDYETKTENASYDPLAPFKIMVRPELISLLAVQGLQFTTWICHMTTLSEHLNKDYGLPMVIIGVCLPAGLCTLTSVVLAGKFLNWNYRRRFAKHKKFIQNEKKILLEENDYDSQLVRDIIDQDIQHKFDLYKTRLDYAYVPIIISNAGFIIFGWCIGTKQHLAVILVMSGLASLMCNCMISISNTLVVDLYPERASTAAGCVNFVRCIFTAIMVAALAKMNSSMTVGGTFTFLTCLAWVCSMLLIVPMKYGLRLQLAREKKQSQKTLGRENIDENNIHPEMSEEERELCDLRRSATALSNLSAV

SEQ ID NO: 239 - DNA, 1698 bp, Saccharomyces bayanus
atgacgttggcaaccacagatacgctgtcaggaaacgattttgaagacgaactcacggggagtttgcattcttacaataaagagcatatggagaagctggctttacacagaacttctagtgtgaaaccggaaccggaaattacagccccaccccactcgcggttttctcgttctttcaagattgtgttgatcgctcaatgtgccttcactgggtttttctccactatagcaggtgccatctactaccccgtcctaagtgtcattgaaaaaaaattcgacatcaacgaacagttggttaacgtcaccgttgtcgtatattttgtgttccaagggcttgcccccacgttcatgggcgggtttgcagactcattaggtaggaggcccgttgtgcttgttgccattctcatctacctcggtgcttgcgttggcctggcttgtgcccagacatatgctcaaattatcgtgctgaggtgtttacaagccgcaggaatttcgcccgtgatagccattaatagcggtatcatgggcgacattactaccagagccgagcgtggagggtacgttgggtatgtagctgggttccaagtgctaggttctgcttttggtgcgcttatcggtgccggattatcgtcgagatggggctggagagctattttctggtttttagccattgggtccggtgtttgtttcctgggatcccttttagtattaccagagacaaagagaaacattgccggaaatgggtctataacaccaaagttgtacttcaatagggctcccatcttggctttaggagtagtaagaaaatcgctgcatttggataatccagattacgaaacgttggaacaacccacacgattaaatttactggcgccattcaagattttaaaatcttacgaaatatgcatattaatgctagtggctgggttacaatttgccatgtatactacacatcttacggcgctatccacagctttaagcaaagaatatagcctggacgtggcccaagtagggttatgctacctgccctctggtgtttgtactctgatcagtattgttaccgcaggcaggtatttgaactggaactataagaataaattgagagactatcgaagttggctagaccaaaaaagatcggaacttttagaggcacacgataacgatctgaatgtggtacaacaaatcatagaggacgactcccaatatactttcaatatctttagagcaagattgcaacctgcatttgttaccttaatcttgagtagtagtggattctgtgcctatggctggtgtatcaccgctaaggcccccttagcagccgtcttgtgcatgagtgggtttgcatcactcttttccaattgcattttgaccttctccactactcttattgtcgatttgtttccttcaaagacttccactgccaccggatgtttaaacctatttagatgcatcttgtccgctgttttcattgctgcattgagcaaaatggtggagaagatgaaatacggaggcgtatttacgttcataggagctttaacctcctcgtcctcgattcttttatttattctcttaaggaaggggaaagaactgacctttgagaggaaaaggcaagaacgagagactaccgaagagataaggcttcctgaaccaaaggaaagcgcatcgcctgaccttctgaccactgatgaagaagtatga

SEQ ID NO: 240 - protein, 565 aa, Saccharomyces bayanus
MTLATTDTLSGNDFEDELTGSLHSYNKEHMEKLALHRTSSVKPEPEITAPPHSRFSRSFKIVLIAQCAFTGFFSTIAGAIYYPVLSVIEKKFDINEQLVNVTVVVYFVFQGLAPTFMGGFADSLGRRPVVLVAILIYLGACVGLACAQTYAQIIVLRCLQAAGISPVIAINSGIMGDITTRAERGGYVGYVAGFQVLGSAFGALIGAGLSSRWGWRAIFWFLAIGSGVCFLGSLLVLPETKRNIAGNGSITPKLYFNRAPILALGVVRKSLHLDNPDYETLEQPTRLNLLAPFKILKSYEICILMLVAGLQFAMYTTHLTALSTALSKEYSLDVAQVGLCYLPSGVCTLISIVTAGRYLNWNYKNKLRDYRSWLDQKRSELLEAHDNDLNVVQQIIEDDSQYTFNIFRARLQPAFVTLILSSSGFCAYGWCITAKAPLAAVLCMSGFASLFSNCILTFSTTLIVDLFPSKTSTATGCLNLFRCILSAVFIAALSKMVEKMKYGGVFTFIGALTSSSSILLFILLRKGKELTFERKRQERETTEEIRLPEPKESASPDLLTTDEEV

SEQ ID NO: 241 - DNA, 1779 bp, Candida glabrata
atggtggaaagtggtccacattcaattaatgatgatttgtcaacgaacgaatacatagaacaacctaaattctatcacgatgaccacgctagtgatagtaatagcctgtcagatatagacgacgacaataagaagcatggcggattgtatggaacagtctccagaactaccacaagagagctaccagaagacctggagtctgagatttcttcaactcactcacaagatgctaaagaggacttggagatacagcacaacgcggctccatactccctgctgaactacagagataaatggtgtatggttgccctacttacagcatgtgggttctggtcttctttgggttccccaatttattatccagctctgaaacagttagaaaaacagttcgacatcgatgaaaatatggtcaatatcacagttgtggtgtatctattattccaaggtttggccccaacttgtagtggtggtctagctgataagttcggccgtagacctgttctacttatcggtatgctgatctacgtggttgcctccattggtctggcttgtgctccatcatatggtgttattgttttcctaagatgtgtacagagtattggtatctcaccaagtatcgctatcagctcaggtgtcgttggtgatttcactgtcaaatctgaaagaggcacattcgttggtgctacttctggctttgtgcttttaggtcaagcatttggttccctaattggtgccgctctggcagctgcatgggattggagagccatcttttggttcctaactattggttgtggtgcatcatttgctatctgctttgcgctacttccagagacaaagagatccattgtcggtaacttgtctatcagaccaaagaatccattaaatatcgccccagtcaccttgctaccagccgcaagaagaaagttaaagtacgataaccctgattatgagacactagacaagaccaagccggtttttgatttgacatctgctttcaaaatttgtgccctgcctgaaatcttcttatctctactaccaccaggtttagcctttgccatgtggacactaatgttgtctgctatttcatctgaattgtcagctgctccatacaactataagttaacgatcatcggtgtttgctacctgccagccggtattggtggtctgattggttcctttgctactggtaagattatagatttccaatataagaagaagttgaaggtatttgaagagaaaaaggctgctggaattattccagaagatgagaaattcaatatcatgggtgctagattgcaatctgttcttccacagaactttttgtgtgttgtcacatatatccttttcggatggagttgtgacaaaggctggaagattccttcgatcttaattacctcttgtgttagctccttctgtgcaatgagtactctttctgctatgagcacacttttggttgatctttacccagggaagtcatctacggctagtagttgtttcaacttcatgagatgtagtttaagtgccattctgatgggttgttttgccaagatgaagcattccttaacagtaggtggtacattcactctgttggctggtctagttttcgtcggtaacttcctaatgttcattccaatgaagcacggaatgagatggagagaagaaagagaacaaagagctgctcttaaggcgaaaagcatggatcaagctaatgagaacggctacaagttgttcagcaagataaagttctcttcgccattcaaatctgaagaaaaagtatga

SEQ ID NO: 242 - protein, 592 aa, Candida glabrata
MVESGPHSINDDLSTNEYIEQPKFYHDDHASDSNSLSDIDDDNKKHGGLYGTVSRTTTRELPEDLESEISSTHSQDAKEDLEIQHNAAPYSLLNYRDKWCMVALLTACGFWSSLGSPIYYPALKQLEKQFDIDENMVNITVVVYLLFQGLAPTCSGGLADKFGRRPVLLIGMLIYVVASIGLACAPSYGVIVFLRCVQSIGISPSIAISSGVVGDFTVKSERGTFVGATSGFVLLGQAFGSLIGAALAAAWDWRAIFWFLTIGCGASFAICFALLPETKRSIVGNLSIRPKNPLNIAPVTLLPAARRKLKYDNPDYETLDKTKPVFDLTSAFKICALPEIFLSLLPPGLAFAMWTLMLSAISSELSAAPYNYKLTIIGVCYLPAGIGGLIGSFATGKIIDFQYKKKLKVFEEKKAAGIIPEDEKFNIMGARLQSVLPQNFLCVVTYILFGWSCDKGWKIPSILITSCVSSFCAMSTLSAMSTLLVDLYPGKSSTASSCFNFMRCSLSAILMGCFAKMKHSLTVGGTFTLLAGLVFVGNFLMFIPMKHGMRWREEREQRAALKAKSMDQANENGYKLFSKIKFSSPFKSEEKV

SEQ ID NO: 243 - DNA, 1590 bp, Kluyveromyces waltii
atggatgctgaaaaggttcgtgaagcaccacactcgcgatttgggccacgggagaaattcgtgcttgtgctcgtgtgcgcatctacgggcttcttttctaccattgcaggtgctatttactaccctgcccttaacacaattgaaggccagttccacataagcaccgaactcgtgaatgtctcaatcgtactatatttccttttccaaggcctgtctcccactcttatgggcggcctcgccgactccttcggtcgccgacccgttgtgctctggtctgtggcactttacatggccgcctgcataggcatcgcctgttccaaaacttacgctcagatccttgttctccgttgtttgcagagtgctggcatctctcccgtcatagccgtcaacagtggtatcatgggcgacgtgaccactcgcgaacagaggggtggttacgtcggactcaccgcgggtttccaggtcataggctcggcttttggtgcgctcatcggcggaggtatagtctccacatggtcatggcgtgctgtcttttggtttttggccatcgcctcgggtttcagccttgttgtcactttcataatgctccccgaaacgaaacgctccatcgtaggcaatggctccatacaaccaaacacgatttggcacatcgccccggttctgatgctgccaaagtgtagacacaggttacatttggatgatccagactcgaatactctcgagccctccgaacgcctcaacctcttggcaccgatcacactctttgtgcgtcccgagatcgcacttctgttaatcgtaacaggtcttcaattttccctttgggtttgtcacctcaccgctatggcgtccttactcgagaaaaattaccacttaaccgtcgctaaagtgggtctatgctacttacccagcggactgtgctctctggtcagcgtagtgggcgcggggagaattcttaactggaattacaagcgtcgtcatgccatttttcaaaaatttattaacacttctacccagcagctcttacttgaaaatgataatgacagcgaccgtgtcgagcacatccttcactcacacctcaaatatgcctttaatatctttcgtgctcgactcgagatcatctttgcaccacttctcctcagcggagctgcgtttatagcctttgggtggtgcttagatgtgcatgcaccgctagcaacagtcctagtattcagcggtgtcgcatctctattctctaactgcgtcattgcttgcgctaccaccctcgtcgtcgatctttaccccaaaaaatcctcaaccgctacaggctgcgtcaattttgcacgttgtatcatggcggctattttagttgcagcactcagtagcatgatgtctgcaatgtcagttggtgggacttttactttcttggcagcgttaaccatttcttcaacgacactgctcatcataccaataaaatatggtctaaaaatgatgtacagaaggaagatggacgaagatagccaaaccactgaacaatcttccgcgcaacgcccctcttcggcgaattctcgtgggtccgctaccgatgtcagtcaggacttgccgtccacatga

SEQ ID NO: 244 - protein, 529 aa, Kluyveromyces waltii
MDAEKVREAPHSRFGPREKFVLVLVCASTGFFSTIAGAIYYPALNTIEGQFHISTELVNVSIVLYFLFQGLSPTLMGGLADSFGRRPVVLWSVALYMAACIGIACSKTYAQILVLRCLQSAGISPVIAVNSGIMGDVTTREQRGGYVGLTAGFQVIGSAFGALIGGGIVSTWSWRAVFWFLAIASGFSLVVTFIMLPETKRSIVGNGSIQPNTIWHIAPVLMLPKCRHRLHLDDPDSNTLEPSERLNLLAPITLFVRPEIALLLIVTGLQFSLWVCHLTAMASLLEKNYHLTVAKVGLCYLPSGLCSLVSVVGAGRILNWNYKRRHAIFQKFINTSTQQLLLENDNDSDRVEHILHSHLKYAFNIFRARLEIIFAPLLLSGAAFIAFGWCLDVHAPLATVLVFSGVASLFSNCVIACATTLVVDLYPKKSSTATGCVNFARCIMAAILVAALSSMMSAMSVGGTFTFLAALTISSTTLLIIPIKYGLKMMYRRKMDEDSQTTEQSSAQRPSSANSRGSATDVSQDLPST

SEQ ID NO: 245 - DNA, 1719 bp, Saccharomyces castelli
atgactggatctgagatggcgaaggataagaaacaagaaatagaaataactcagaatttgaaagactatgattatatagatgctcaatccgagcaatcgagcatattaagctacaacaagccagttcatatccacgagacatcagcaacggctgatttatgcaagacacaatcgaataaaaaagatgaacctaatctcgacaatgctgttccatattcgcgttttggttcctccgagaagacgattctcgttttacaatgtgccttcactggatttttctcaaccattgcaggtgccatctactatcctgtcctatcagaaattgaggaaatattccacatctcggaagaatctgtcaatataacagtggtggtctactttatctttcaaggtatttctccaagtatcatgggtggactagctgatacaatgggaagacgtcccattgttttatgttccatagccgtgtacttctgtgcttgcattgggttggcatgctgtcaaacctaccctcaaattgttgtcctgagatgtctccaagcggcaggtatatcaccagttattgctatcaatagtggtatcatgggtgatatcactacgagagcagaaagaggtgggtttgttggttatgtttctggatttcaagttatgggcagtgcatttggggcattgattggggctggtatctctagtacttggagctggagagcaattttttggtttttggccattggttctggtatctgtttgatcatatccttcattatcttacctgaaacaaaaagaactattgttggtaatggttctatcattccaaaatcaaaacttaatagagctccaagtttaatggttccatatttaagaaagaaattacatttagacaaccctgattgggaaaccatggaaccaaagattcatttaaatttttttgctccatttggtatattgaaaaatactgaagttttcatattattatttgtttctggtttacaatttgccacgtataccacacatcaaacagcattatctactgtattgagcagtaaataccatcttacagtagctaaaatcggactttgttatttaccatcaggtatctgcacattaattagtgttgttacctctgggagataccttaactggacttatagacgtcaaatagctagacatcaaacttggttaaaagaacaagaagctatactcctggaacaatataacaatgacattgttgaagtgaaagatattatggagaataatccaaaatatacatttaatatcttcaaagccagattacagccagcattttttactttaattctaagtgcttctggattttgcgcattcggatggtgtcttagtgtcaaagctccattggcagccgttttggtgacgagtggatttggatccttattttccaactgtatcctaactttctcaactactttagttgtggatctatttccaacaaaggcctctacggccacaggctgtttgaatttattcagatgcataatatcagctatttacattgggtgtttaagtaggatggctgattcaatgacatacggtggtgtttttactttcatgtcggcattagcagctgtatcttcgacattactttttattccagttggtaatgggaaaaaattggcattgaaaagaagaaagcaggaacagaaagccttgcaacccaaacaagaaaaggattcagcagtctaa

SEQ ID NO: 246 - protein, 572 aa, Saccharomyces castelli
MTGSEMAKDKKQEIEITQNLKDYDYIDAQSEQSSILSYNKPVHIHETSATADLCKTQSNKKDEPNLDNAVPYSRFGSSEKTILVLQCAFTGFFSTIAGAIYYPVLSEIEEIFHISEESVNITVVVYFIFQGISPSIMGGLADTMGRRPIVLCSIAVYFCACIGLACCQTYPQIVVLRCLQAAGISPVIAINSGIMGDITTRAERGGFVGYVSGFQVMGSAFGALIGAGISSTWSWRAIFWFLAIGSGICLIISFIILPETKRTIVGNGSIIPKSKLNRAPSLMVPYLRKKLHLDNPDWETMEPKIHLNFFAPFGILKNTEVFILLFVSGLQFATYTTHQTALSTVLSSKYHLTVAKIGLCYLPSGICTLISVVTSGRYLNWTYRRQIARHQTWLKEQEAILLEQYNNDIVEVKDIMENNPKYTFNIFKARLQPAFFTLILSASGFCAFGWCLSVKAPLAAVLVTSGFGSLFSNCILTFSTTLVVDLFPTKASTATGCLNLFRCIISAIYIGCLSRMADSMTYGGVFTFMSALAAVSSTLLFIPVGNGKKLALKRRKQEQKALQPKQEKDSAV

SEQ ID NO: 247 - DNA, 1662 bp, Kluyveromyces waltii
atggatacccatagttaccaatcgagtatattaagtgaaagcgacgcacaaagcgccaaccatctcgaaaaagaggtccatcaattaaaccatgatggtaacaaacacaagtatgagcaggatgcgccatcgagagtgacgacgcacgagatgaaagggtcgtcgtctgagtctattgaaggtcatgatatagcgcacgacaatgctccactgccgcagcacgcaccttacactctgttgagcaatgctcagaagtggtgcatggtggcgcttttgacttcagccggtttttggtcttccctggggtctcccatctattatcctgcgctgaagcagctggagaaacagtttagtgtcagcgaggagctagtaaatataaccgttgtggtgtacctgatatttcagggtgttgctcctacaatcagcggtggtctggccgacgtatatggccgcaggcccgtcattctaattggtatgctgatttacgtctgtgcctcgatcggattggcgtgttctaactcctacggagtaattgtattccttagatgccttcagagtgctggcatttccccaatcattgccatcaactctggggtagtaggggacttcaccgtgaaacaagagcgtggaacctttgtgggagccgtgtcggggttcaccttaatggggcaggccttcggatctctcataggtgccgcgcttactgcagcatttgattggagggcgattttctggtttttaaccattggctgcggaacttgtatgctcgtgaatttcctgcttctccccgagaccaagagatcaattgtcggtaatatgtcgatcaaacccaaatctttcgttaatagggctcctatattccttctcaagtctgttcaaagacgttttcactacgacgttccagattaccagactttagaccccacaaaggccaaggtggacccaatatccgccatgaagatcctcgcgcaccctgagatcattatgtcgttgatgccagcgggtttgcaatttgctctttggaccattactcttgcatccatttcttcacagttatcggtcgaaccatacaactataaattgaccataataggtgtttgctatctaccttctggtattggaggtctggttggatcttttgttaccggaaagatcattgacatatactacaaaagagcagttcggagattcgaagagaaaaaagagaaaggactcattcccgcagataccaaattcaataccttaagagcacgcctctacacttccattccccaaaacttcttgtctgtgattgccttcacgttgtttggctggagtgttgagcgtggatggcacattgcagtgcccttgataacttcttgcattggctccttttgtgccatgagcacattatcatcatcaagtactctgttagtggacctttatcccagcaagtcctcgaccgcaacaagttgttacaatttcatacgttgctcactaagtgcaattttcatggcctgtttagccaaaatgaacaaggcccttacagtcggtggaacattcacgcttattagtggttttgttttcatcggaaacttcataactttcattcccatgttttatgggatgcagtggcgccagaagagagcattgaaagctgagagaaaggccatgttggagtga

SEQ ID NO: 248 - protein, 553 aa, Kluyveromyces waltii
MDTHSYQSSILSESDAQSANHLEKEVHQLNHDGNKHKYEQDAPSRVTTHEMKGSSSESIEGHDIAHDNAPLPQHAPYTLLSNAQKWCMVALLTSAGFWSSLGSPIYYPALKQLEKQFSVSEELVNITVVVYLIFQGVAPTISGGLADVYGRRPVILIGMLIYVCASIGLACSNSYGVIVFLRCLQSAGISPIIAINSGVVGDFTVKQERGTFVGAVSGFTLMGQAFGSLIGAALTAAFDWRAIFWFLTIGCGTCMLVNFLLLPETKRSIVGNMSIKPKSFVNRAPIFLLKSVQRRFHYDVPDYQTLDPTKAKVDPISAMKILAHPEIIMSLMPAGLQFALWTITLASISSQLSVEPYNYKLTIIGVCYLPSGIGGLVGSFVTGKIIDIYYKRAVRRFEEKKEKGLIPADTKFNTLRARLYTSIPQNFLSVIAFTLFGWSVERGWHIAVPLITSCIGSFCAMSTLSSSSTLLVDLYPSKSSTATSCYNFIRCSLSAIFMACLAKMNKALTVGGTFTLISGFVFIGNFITFIPMFYGMQWRQKRALKAERKAMLE

SEQ ID NO: 249 - DNA, 1692 bp, Kluyveromyces thermotolerans
atgggtgaaaactatataaaccagggaaaacaagcggatcctgttcctgaccttccccacatgaaaccaaacatgcccgaccacgatcagggtgctgtaccgtattcgcggtttggctccaacgagaagcttgttctcgtggctatatgtgcagcaagcggtatcttctccactatagctggccccatatactatcctgctctgactacaatcgagaaccagttccatataagcacggagctcgtcaacgtgtcggtggtgctctactttctgttccaaggcctggctcctacgctcatgggcggactcgccgattctttcggccgtaggccaatcgtgatgtggtctatcgcgctgtacttggccgcatgcatcgggatcgcctgctctcggacgtatgcccagatcctcgtcctgagatgcttgcagagcgccggtatctcgcctgtcatcgcggttaacagcggcatcatgggggacgtcactacccgagcgcagcggggcggctacgtcgggcttacggcgggcttccaggttctcgggtctgctttcggcgccctaattggaggcggtatcgtatcgacctggggctggcgggccatcttttggttcctggcgatcggttccggatgcagccttgtgtgcagcagccttctgctgcccgagacaaagcggtccgttgttggtaacggctccataacgcctccggcaatatggtccaaggcgcctatactggccctgccgcaaatccgaaagaaactgcacttggatagccccgattacgagacgcttgctccaaaagaacgactcaatcttcttgcacctctcgatgttttccggaggcctgaaatcgctctgttgctgctagtgactgggctacagttttcgctctgggtctgccacctcaccgcactgtcttctctcctggagaaggactatcacttgaaagtggctgaggtcggtttaagctatttaccaagcggcatctgcacgctcattagtgttgtgggagcgggcagggtattaaattggaactacagacgccgcctctcgaaacacaacctcttcatcgaggaggctactcagaggctactagctgaaaatgacaacgacgaaaaacgagtggacaaaatcctcagcactgacatctcctacaccttcaacatcttccgtgctaggttggaaattatgtttgtgcccctgctgctaagcggaggcgggtttatggggttcggatggtgcttggatgctcacacgccgttagtagctgtgcttgtgttcagcggatttgcgtcgctgttttccaactgcgtcattgcgtgtgcgacaactttggtggttgacctatatcctcagaaatcctcgacggcgacgggctgcgtcaacttttctcggtgtgttttggctgcaattttggttgcagctctcaacaagatgctaacctcgctgtcagtaggcggtacttttacgcttttggcaggtcttactatattatcgacggttacacttatcatcccgatcaagtacggccctgggatggcacacaagagagctgtccgggatcgcaccgcggctgacgaaaaagccgaagccgcagtcaaagaagtcgaccaacagcgccagtcctcggagtctgaggacctttcgagccttaacaccatctcacagcctagatcacgtgcaggagtgtaa

SEQ ID NO: 250 - protein, 563 aa, Kluyveromyces thermotolerans
MGENYINQGKQADPVPDLPHMKPNMPDHDQGAVPYSRFGSNEKLVLVAICAASGIFSTIAGPIYYPALTTIENQFHISTELVNVSVVLYFLFQGLAPTLMGGLADSFGRRPIVMWSIALYLAACIGIACSRTYAQILVLRCLQSAGISPVIAVNSGIMGDVTTRAQRGGYVGLTAGFQVLGSAFGALIGGGIVSTWGWRAIFWFLAIGSGCSLVCSSLLLPETKRSVVGNGSITPPAIWSKAPILALPQIRKKLHLDSPDYETLAPKERLNLLAPLDVFRRPEIALLLLVTGLQFSLWVCHLTALSSLLEKDYHLKVAEVGLSYLPSGICTLISVVGAGRVLNWNYRRRLSKHNLFIEEATQRLLAENDNDEKRVDKILSTDISYTFNIFRARLEIMFVPLLLSGGGFMGFGWCLDAHTPLVAVLVFSGFASLFSNCVIACATTLVVDLYPQKSSTATGCVNFSRCVLAAILVAALNKMLTSLSVGGTFTLLAGLTILSTVTLIIPIKYGPGMAHKRAVRDRTAADEKAEAAVKEVDQQRQSSESEDLSSLNTISQPRSRAGV

SEQ ID NO: 251 - DNA, 1629 bp, Kluyveromyces lactis
atgagaagagctagtatcagaggaacggaccttcaggcagatactgaaacgaaaaagaagaactgcgataacacaggatctgaaagctctgtcttcaggactgtaacaagagaactgcgagatgacactgatgatgttgtgacgcatgaaatatatgatgaggaatctttccctgatggttcaaaacaggaacaactctcagaagaggatgtgccgtatacccttttaacgtaccgtcagaaatggtttatggtcgcattattgacttctgcaggcttctggtcctccttagggtcgccgatttactatccagcgttgaaagagttggaagcagagtttgatgttaatgaagaacttattaatatcactgttgtcgtatacttactttttcaaggtatagccccaaccatcagcggtggtttagcggatgtgtacggaagaagacctattattttgttaggaatgttaatatatgtgattgcatctataggtcttgcatgttctaagtcgtatggtgcggttgtgttcttacgttgcctgcaaagtgcaggtatatctcctatcattgccataaattctggtgttgcaggagatttcacagtaaaatctgaacgtgggacttttgtcggcgctgtttctgggtttactttaatgggccaggcgttcggctctttgattggtgcagccttgacagcggcatatgactggcgagcaattttttggttccttgtaattggatgtgggacttgtatgattattctgtgtttcttgctaattgaaaccaaacgtaccattgtggggaacttatctattagaccaaaaagttggataaatatagccccaataactcgtttgcctgcaataaggaagcaattcaaatatgataatccagattattcatcaagagacttatcagaagtgaagttcgatatcacctcagcaatgagaattcttatattgccagaaatcatcttatcacttctccccgctgcattccaattttccttatggactctttctcttgcttctcttccagcggaacttgcattagatccatacgactactcattgactatgattggtgtatgctatttaccctctggtatcggtggcttgttaggatctttctgtacaggaaaaattattgatgtgtattataaaaggtcccataaaaagttcttggagaagaaagaggcaggtcttatcgataaagatgcaagatttaatacctttaaggctagattaatttctggtgctcctcaaaatgtttgcgctgctgtggttttcactctattcggatgggcactgaagcaaaggtggcacattgcagttgttttagttacatccttcatcggctcgttttgtgctatgagtactctttctacttcaagtacgcttttggtcgatttatacccaagtaaatcctcaacagcaacaagctgttacaatttcatgcgttgcgtattgtctgcaattttcatggcatgtttctcaaaaatgaaatcatcgatgaacgttggtgggacattcacctgcatcagtggaatggttttcgttgggaactttttaattcttattcccatgaaatatggtatgaagtggagatatgaaagaggaatgaagctttga

SEQ ID NO: 252 - protein, 542 aa, Kluyveromyces lactis
MRRASIRGTDLQADTETKKKNCDNTGSESSVFRTVTRELRDDTDDVVTHEIYDEESFPDGSKQEQLSEEDVPYTLLTYRQKWFMVALLTSAGFWSSLGSPIYYPALKELEAEFDVNEELINITVVVYLLFQGIAPTISGGLADVYGRRPIILLGMLIYVIASIGLACSKSYGAVVFLRCLQSAGISPIIAINSGVAGDFTVKSERGTFVGAVSGFTLMGQAFGSLIGAALTAAYDWRAIFWFLVIGCGTCMIILCFLLIETKRTIVGNLSIRPKSWINIAPITRLPAIRKQFKYDNPDYSSRDLSEVKFDITSAMRILILPEIILSLLPAAFQFSLWTLSLASLPAELALDPYDYSLTMIGVCYLPSGIGGLLGSFCTGKIIDVYYKRSHKKFLEKKEAGLIDKDARFNTFKARLISGAPQNVCAAVVFTLFGWALKQRWHIAVVLVTSFIGSFCAMSTLSTSSTLLVDLYPSKSSTATSCYNFMRCVLSAIFMACFSKMKSSMNVGGTFTCISGMVFVGNFLILIPMKYGMKWRYERGMKL

SEQ ID NO: 253 - DNA, 1671 bp, Saccharomyces bayanus
atgaccaaacgacaaattggagtaatgctcaatgcatataggcccgagggtgaatcggaaagggatgaaatcggctccggaccagatcacggggagaccagtggcctggcagtatccaactctcaatcagaagtaggcaatgaatcagactttgaattagagccttattcaagattcagtcatactcaaaaaatgcttcttgtcgttcagtgcgccttcacaggcttcttttccacggttgcaggatccatctattatccagtgcttactgtgattgagaaaaaattcaacatcactgaagagttggctaacgtcactattgtggtttattttgtcttccaagggctggcaccctcgattatgggtggattggctgatacgtttggaaggcgacctgttgtactgtgggcagtgttaacatactgctgcgcatgtattgggttagcaagctcacataattacgctcaaatcctagcattaaggtgtttgcaagcggcaggtatttctcctgttattgcaataaatagtggaataatgggcgacgtaactacaaaggtagagaggggcggatacgttggattagtgtcaggtttccaagtggttgggacagcatttggtgcattgattggtgccggattatcatcaaggtggggttggagagctattttttggtttttggcaataggttccggaatctgtttggttgtttccgctctccttttacctgaaacaaaaagaacgttggtgggaaatggttcaataacgccaagatcgtttttgaatcgggccctcatactacatgttgccagtgtgaggaaaacccttcatttggatgctcctgaattggatacgttagaaccacgtgttagagtggactttttagctcctttaaaaattttgcacatacgtgaaatagatatcctgttattcattgctggtttgcaattttctacatggacaacccatcagactgcactgactacggtactgagcaagaagtataatttatcagtggccaaaattgggctttgctttttgccagcaggaatttccacactgacgagtgttatctcggctggtagatatttaaattggagctatagaacaaggaaagtcaaatataacaaatggataaaagaacaagagctacagttgattgaacagtacaagggtgatcacgataaggtggctgaagttctacagtccgattatcattattcctttaatctggtcgaagcaagactacatccagcatttgtgacacttcttttcagtagtgcagggtttactgcattcgggtggtgtatttctgtgaaagcacctcttgctgctgttttatgtatgagtgcattcgcaagtttattttcaaattgcattctgaccttttctactactttaatcgtggatttattcccatcgaaagcatctactgccacaggatgtttgaacttatttagatgcattttgtcagctattttcattgcagccctaagtaagatggcagagaagatgaaatacggaggcgttttcacatttttgagtgctttgacttcatcttcatctatattattatttcatcttttgaagaatgggaaaaaaatatcgtttgatagggctaaagaagctggtaagtcagccattaaagacaagtctgagaaaacaaaagcatga

SEQ ID NO: 254 - protein, 556 aa, Saccharomyces bayanus
MTKRQIGVMLNAYRPEGESERDEIGSGPDHGETSGLAVSNSQSEVGNESDFELEPYSRFSHTQKMLLVVQCAFTGFFSTVAGSIYYPVLTVIEKKFNITEELANVTIVVYFVFQGLAPSIMGGLADTFGRRPVVLWAVLTYCCACIGLASSHNYAQILALRCLQAAGISPVIAINSGIMGDVTTKVERGGYVGLVSGFQVVGTAFGALIGAGLSSRWGWRAIFWFLAIGSGICLVVSALLLPETKRTLVGNGSITPRSFLNRALILHVASVRKTLHLDAPELDTLEPRVRVDFLAPLKILHIREIDILLFIAGLQFSTWTTHQTALTTVLSKKYNLSVAKIGLCFLPAGISTLTSVISAGRYLNWSYRTRKVKYNKWIKEQELQLIEQYKGDHDKVAEVLQSDYHYSFNLVEARLHPAFVTLLFSSAGFTAFGWCISVKAPLAAVLCMSAFASLFSNCILTFSTTLIVDLFPSKASTATGCLNLFRCILSAIFIAALSKMAEKMKYGGVFTFLSALTSSSSILLFHLLKNGKKISFDRAKEAGKSAIKDKSEKTKA

SEQ ID NO: 255 - DNA, 1803 bp, Saccharomyces kluyveri
atggctgataggcagaatacattaaaaaccaagaataaaactcattcatcaacttcagaagtcttttcagaagttctcttaccccctctagaacagcatgccagtaacgaaatccagtgtaccgatgataaccagaaggtaatcgaacaaatttcaaaaccctcatctgcaaatccaaataacgaaaaaacctgtcaggaacccccttattcaaggttcggaaaatccgaaaaatcaatcttagctgtactatgtgcatctgctggacttttttcgaccatttctgctcctatttattatccggctttgaccatcattgaggaagatttcaatatcagccaggagatggtaaatatcaccgttgttgtctattttatactacaaggattggctcctatgttgatgggagggttagcagacaaggttgggagaagacccatcgtattatgttctattgcattgtacgctgtagcatgcataggtttagcaagcgcccaaaactacggggaggtactgtttttgagatgtttacagagtgcaggaatttcaccagtcgttgctgtgaataatggtataataggagatatcacaaccaaggcagagagaggtggttatttggggttaatggcgggaacccaagtgattggctctgcatttggtgcattgataggcgcaggaatcactgctagatggggttggagggctatattctggtttctggccattggttcaggtttcagtttggcagtggcatcctttttgcttcctgaaacaaagagaactgttgtgggcaatggctccatagttcccaaaaacccagtctgtaagtctccggtactcttactgccatgtataaaaaaaagcttacatcttgataacccagattacgaaaccttggcaccacctcaaagactagatctactggcgccgcttgatgtcatgagatgtcccgacgttgcaattacactgctagttgccggcttacagttttctacctggacctgtcatttgactgcgctatcctcattgttagccaaggattacaaattaaaggtggcacaggtgggtctatgttatttgccaagtggtatttgtacgctgataagcgtcgtttccagcggcaaagccttaaactggaattacaggcgccgcttcaaacagcaccaggcatggttggggagcataagagaggaactaatgaaagaacattacaatgagaccagttttgtcgacgagctattaaaaacagaatcacaatacaagttcaacatttacaaggtcaggttagaaatcgcattcattccgtcaattctgagcagcgccgggttcgtaacatttgggtggtgtttgaatgaaaaggcaccgttggtcagtgttttggtgtccagtgggttcgcatcgctattttccaactgcattcttgccttttcatcaacactagctgtagatctatttccagaaaggtcctcgaccgctagtggttgtctcaatttttcccgttgcattctctccgctatattcgttgctgtcctaagcaagatgctaaacactttaaagcccggaggcacattcactcttcttgcaatactagcagctacatcttcactcctactgataattccaataaagtacggcacattatggcaacacaagcgtcagcaaaaagaacagcaaaagcaagacatgcaggagaagaacaaaaaaaaactgaaaataccgtttaacaaaccaccgacagcgaccccagataatctagaagagccggagctagtcagagggcccaatggtcccttgctcgagtaa

SEQ ID NO: 256 - protein, 600 aa, Saccharomyces kluyveri
MADRQNTLKTKNKTHSSTSEVFSEVLLPPLEQHASNEIQCTDDNQKVIEQISKPSSANPNNEKTCQEPPYSRFGKSEKSILAVLCASAGLFSTISAPIYYPALTIIEEDFNISQEMVNITVVVYFILQGLAPMLMGGLADKVGRRPIVLCSIALYAVACIGLASAQNYGEVLFLRCLQSAGISPVVAVNNGIIGDITTKAERGGYLGLMAGTQVIGSAFGALIGAGITARWGWRAIFWFLAIGSGFSLAVASFLLPETKRTVVGNGSIVPKNPVCKSPVLLLPCIKKSLHLDNPDYETLAPPQRLDLLAPLDVMRCPDVAITLLVAGLQFSTWTCHLTALSSLLAKDYKLKVAQVGLCYLPSGICTLISVVSSGKALNWNYRRRFKQHQAWLGSIREELMKEHYNETSFVDELLKTESQYKFNIYKVRLEIAFIPSILSSAGFVTFGWCLNEKAPLVSVLVSSGFASLFSNCILAFSSTLAVDLFPERSSTASGCLNFSRCILSAIFVAVLSKMLNTLKPGGTFTLLAILAATSSLLLIIPIKYGTLWQHKRQQKEQQKQDMQEKNKKKLKIPFNKPPTATPDNLEEPELVRGPNGPLLE

SEQ ID NO: 257 - DNA, 1605 bp, Ashbya gossypii
atgttgacgaggatttcgagcacagattcttcgccgagggccaaggaagacgttccacagctgaaactgttgaaagaggccgatgatggactggtagacagttcttccagctccccagagcccgatgagaagatcggggaagcatgtgtatcaacttctgaaatcagcaaaattccgcactcgatgcttcgatactcgcagaagtggatgatggtagccctgctgacatcagcaggattttggtcatcgctgggctcaccggcggtatatccagcgctgcgaaacctacagagggaattcggggtaagcgaagacttggtgaatattgcagtggttgtttatttgcttttccagggggttgcaccgaccgtatgcagtggattggcggacacgtacggtcggcgcccggtgattttgatgggaatgctaatattcattgtttcctcaataggcatcgcatgctcgaactctttcgccttggtgatcgcgcttcgctgcatccaaagttccggcatctccccaataatagctatcaactccggggttgtcggcgattttacactaaaatcggagagaggaacgtttattggcgctgtctctgggttaacgctactaggacaagcatttggttccctaataggagcatcattgacagcagcctacaactggagagcagttttttggttcatgactatcggctgtggagtatgctttctggcaaacttcctcttccttccggaaacgcaccgttgtattgttgggaacctctcgctgaaacccaaaaggaatattaacttctcgcctgtgttactgcttcctgtgatacgaagacaattcagcttacagcatccacattattctagcctcgatgataccgtggcaggcctcgacattgtcgccgccttaaaaatcattgcatgtcccgagatcctgctcaccctattaccagcaggactgcaattttctctctggactctttccctcacatcgctatcgcaggccttgcagagtgatccgtataactatccgctcacgactgtaggcctatgttacttgccatccggaatctgcggcctactgggatctttcctgactggcaagttgatagacatctggtatagatactttgccgataggtttcagcgccgtagcgcaaattctagtggccccagcgcaccgtttaatgtccttgaggccagaatagtggctggattgcctcagaattttatttcggtcatggctttcattatattcggctggtccattcagggcggctggcacatctcagtccctttggtcgcatccggtgttggtacgttctgcgttatgagtacactcagcacttcgagtacgctgctcattgacttgtatccgaatagagcttcgactgcctcaagttgttacaactttattaggtgcacgctaagtgccttattcctggcagtctttgcaagaatgaaagcgtcaatgactattggtggtacatttacctttctgtgcagtctaatatttgttggtaattgcgctttgattttcccgatgaaatatggaatgacttggcgtgataggcggttgcggcgcgcagctgaagcgtcctgtaattaa

SEQ ID NO: 258 - protein, 534 aa, Ashbya gossypii
MLTRISSTDSSPRAKEDVPQLKLLKEADDGLVDSSSSSPEPDEKIGEACVSTSEISKIPHSMLRYSQKWMMVALLTSAGFWSSLGSPAVYPALRNLQREFGVSEDLVNIAVVVYLLFQGVAPTVCSGLADTYGRRPVILMGMLIFIVSSIGIACSNSFALVIALRCIQSSGISPIIAINSGVVGDFTLKSERGTFIGAVSGLTLLGQAFGSLIGASLTAAYNWRAVFWFMTIGCGVCFLANFLFLPETHRCIVGNLSLKPKRNINFSPVLLLPVIRRQFSLQHPHYSSLDDTVAGLDIVAALKIIACPEILLTLLPAGLQFSLWTLSLTSLSQALQSDPYNYPLTTVGLCYLPSGICGLLGSFLTGKLIDIWYRYFADRFQRRSANSSGPSAPFNVLEARIVAGLPQNFISVMAFIIFGWSIQGGWHISVPLVASGVGTFCVMSTLSTSSTLLIDLYPNRASTASSCYNFIRCTLSALFLAVFARMKASMTIGGTFTFLCSLIFVGNCALIFPMKYGMTWRDRRLRRAAEASCN

SEQ ID NO: 259 - DNA, 1746 bp, Saccharomyces castelli
atgtcatctgatagcatattatacacggatgaggatgaggctggctccattgagaatcttacaagagaatacactggtgataacaaacccaaagaattaatagaggcagttgcttcaaaagatggattataccatttgaatggaacactttcgagggcaactactagagaaatagacggtgattcattacaatcatctgatgaagaaaagaatgaacaagcctccgagagtacatccccttatacattacttacatataaacaaaaatgggggatggttgcacttttaacgatgtgtggtttttggtcatccttaggttcaccaatttattatcctgctttaagacaactagaaaagcaattcggtttggatgaaaacaaagtcaatgtcaccgttgtcgtatatttgttgtttcaaggtattgccccaacaattagtggtgggttagctgatgtgttcggccgtagacccgtcattctaataggtatgctgatatatgttgttgcttccattggtctagcttgtgctccatcatatggtgttattgtatttctaagaattatccaaagtattggtatttctcctaccattgctattagttcaggtgtcgttggtgatttcacattgaagcacgaaagaggtactttcgtcggggctacttcaggattggtgttgttaggtcaatgttttggaagtttaatcggtgctgtgttagcagctgcttggaattggagagcaattttctggtttttgaccatcggatgtggtacctcgtttataattgcattcctcttactacctgaaaccaagaggacacttgtcggaaacttgtctatcaggccaaagaatccatttaattttgctccagttttattacttaaaccagtacagaaaatgtttaagctgaatgatcctgattatgacagtgtagatccaaataaacccagatttgatttaacttctgcacttaagatttgtgcccaaccagaaatcttattatcattgttccctggtgggcttcaatttgctctttggaccgttatgctttcgtcaatttcttccactttgagtgtggctccatataattatagattaaccatcatcggtgtttgttatttaccaggtggtgttggtgggttacttggttccatgttaactggtagatttatcgatttcttatacaagagagccagaagtgattatgaaagaaagaaggcttcaggtgaacttccggaagatgctgtatttaatacttttcaagtccgtttaagagctatcctacctcaaaatttcattgcagtcatttcattcttattatttggatggagtgctgataaaggttggaaaattccagccatgttgattacttcctgcgttagctccttctgtgccatgagtaccttgtcatcatcaactactttattggttgatttgtatcccaagaaggcgtctacagctagtagttgttttaactttatcagatgtagtttaagttcgatctttatgggttgctttgccaagatgaagcattcaatgacagtaggtggtactttcactttcatggttggtttaatatttgtcggtaacttcctcatgtttattccaatgaaatatggtatgcaatggaggctagagagagaagcaaaagacttggcaagagagcaagcaaaacatgatgaaaaagaagccagtctgaataaaaatacacaacaagagaagaaaaagaagagatttttcttcttttaa

SEQ ID NO: 260 - protein, 581 aa, Saccharomyces castelli
MSSDSILYTDEDEAGSIENLTREYTGDNKPKELIEAVASKDGLYHLNGTLSRATTREIDGDSLQSSDEEKNEQASESTSPYTLLTYKQKWGMVALLTMCGFWSSLGSPIYYPALRQLEKQFGLDENKVNVTVVVYLLFQGIAPTISGGLADVFGRRPVILIGMLIYVVASIGLACAPSYGVIVFLRIIQSIGISPTIAISSGVVGDFTLKHERGTFVGATSGLVLLGQCFGSLIGAVLAAAWNWRAIFWFLTIGCGTSFIIAFLLLPETKRTLVGNLSIRPKNPFNFAPVLLLKPVQKMFKLNDPDYDSVDPNKPRFDLTSALKICAQPEILLSLFPGGLQFALWTVMLSSISSTLSVAPYNYRLTIIGVCYLPGGVGGLLGSMLTGRFIDFLYKRARSDYERKKASGELPEDAVFNTFQVRLRAILPQNFIAVISFLLFGWSADKGWKIPAMLITSCVSSFCAMSTLSSSTTLLVDLYPKKASTASSCFNFIRCSLSSIFMGCFAKMKHSMTVGGTFTFMVGLIFVGNFLMFIPMKYGMQWRLEREAKDLAREQAKHDEKEASLNKNTQQEKKKKRFFFF

SEQ ID NO: 261 - DNA, 1746 bp, Kluyveromyces polyspora
atgagtgatgataataaaagtagtctggcaaacctcgattaccatatggatcaatcagattaccctataaaaaagaatctatcttcaacagatttagccgactacggtgtaatagacaaatcatcgataatatcaaaggagaatgatctccataccgctgatcgagataactatgacgatgacgatgacgatgacgatataatagattctctacatatcatgaaaacccaatctgtaaagcttggtccaaacactaccgattctcctccatattcacgatttggtaggaccgaaaagtctttattaataatccagtgtgcttttactggtttcttctcaagtgtagctggtgcaatttattatcctgttttaacagtcatcgaaaagaaatttaatattactgaagaattagttaatattacagttgtagtttactttatatttcaaggtctcgctccttcctttatgggaggtttagccgattcattaggtagacgtcctgtcgttttattctcaatattagtctattgttgtgcatgtataggtttagctttatcccaaaactatacacaaatcgttgttttaagatgtctacaagctgctggtatctcaccagtaattgccatcaatagtggaatctgtggtgacatcactactcgtgctgaaagaggcgcttatgtaggttatgtctctgggttcattgtcatcggtagtgcatttggtgctttgattggtgctggtctatcctcaacttggggttggagatccatcttttggtttttaactataggttcaggtatatgtttgatgatttctattatcgtcttaccggaaactaaaagaactttggtaggaaacggctccattcgtccaagaccttatgtcaatagagcaccaatactttcccttccttatttgaagaataaattacatctcgacaacccagagtacgaaacgttggaacccaaatctccattaaatctgtttgctcctttcaaagtattaaaagtgccagaaattgcaatcttattaatcgtgtctggtttacaattttcaatgtggaccactcaccaaacagcattaagtactgtattaagtaaggattatggattgtctgttgctaaaattggtctatgtttcttaccagcaggtgtctgtacactaattagtgttataagctgtggcaggtatttaaactggagctataaaaaaaaatatgcaagatataaaatatggttagaggaacgtaaaaaagagcttttggaagaatataaagaccctgaaaaagttcatgatattattaacaataatcactattatacgtttaatatatgcaaagcaagattacaacctgcatttgtaacattactaattagtagctgtgggttttgtgcctacggttggtgtataaaaagtaaagctccattagctgctgtcttagttactagtggtatagcttctttattttccaactgtattttaacaatgtcaacaaccctatgtgttgacctatttccatcgatagcgtctactgcgactggttgcctaaatctaactagatgtttgctatccgctctatttattggtgttttaagcagaatggaacagagtatgacttatggtggtgtatttacatttatggcaggtataactggactgtcatctttccttcttttaattccagtcagaaatggtaaaaaattgtcatatttaagaacaaaacaagaggcattactgagaaattga

SEQ ID NO: 262 - protein, 581 aa, Kluyveromyces polyspora
MSDDNKSSLANLDYHMDQSDYPIKKNLSSTDLADYGVIDKSSIISKENDLHTADRDNYDDDDDDDDIIDSLHIMKTQSVKLGPNTTDSPPYSRFGRTEKSLLIIQCAFTGFFSSVAGAIYYPVLTVIEKKFNITEELVNITVVVYFIFQGLAPSFMGGLADSLGRRPVVLFSILVYCCACIGLALSQNYTQIVVLRCLQAAGISPVIAINSGICGDITTRAERGAYVGYVSGFIVIGSAFGALIGAGLSSTWGWRSIFWFLTIGSGICLMISIIVLPETKRTLVGNGSIRPRPYVNRAPILSLPYLKNKLHLDNPEYETLEPKSPLNLFAPFKVLKVPEIAILLIVSGLQFSMWTTHQTALSTVLSKDYGLSVAKIGLCFLPAGVCTLISVISCGRYLNWSYKKKYARYKIWLEERKKELLEEYKDPEKVHDIINNNHYYTFNICKARLQPAFVTLLISSCGFCAYGWCIKSKAPLAAVLVTSGIASLFSNCILTMSTTLCVDLFPSIASTATGCLNLTRCLLSALFIGVLSRMEQSMTYGGVFTFMAGITGLSSFLLLIPVRNGKKLSYLRTKQEALLRN

SEQ ID NO: 263 - DNA, 1656 bp, Kluyveromyces thermotolerans
atggataacaacagcattcactctagcttatcgagtgaaagcgatttacagagcactatgaaactggagaaaccagtactaggtttagagggagataataccaagaagctgctgccgcaggatgccgcctctagggtcaccacgcgggagatgcgcgagtcctcgtcggactcgagggatagagtagaatcttcgggtgtcaactctaagctgccgcaaggcgccccattcacattgctgagtcatggccaaaagtggttcatggtagcgctgttgacttctgcagggttctggtcctctttgggatcccccatctactaccccgcgttgaagcagctagagaagaagttcaatgtgagtgaagaaatggtgaatatcactgtggtggtttacctcattttccagggtattgctcctactatcagtgggggtttggccgatgtctatggccgtagaccagtaatattaatggggatgctcatttatgtgtgcgcgtctatcggcttggcgtgttcccaatcttatggagtcattgtgttcctacgttgcctgcaaagtgcgggtatttctcccattatcgctatcaactcgggtgttgttggcgatttcacgctgaaacacgagcgcggtacttttgtgggagcggtttccggctttacactgatggggcaagcattcggttcgctgataggtgctgctttgacggcagcgtttgactggagagccattttctggtttttaaccatcggttgtggtacctgcatgatcattaatttcctaattctcccagagacaaagagaaccttggtcggcaacttgtcgattaggcccaagagacttatcaacagagcgcccatccttctactgaagtcggtacgcagaaagctccattttgataatcccgactacgagactctagatccaaacaagggtaaagtcgatccaatctctgccttcaaaatcattcttcatccagagatcattttgtcgctgatgcccgctggcctacagtttgccttgtggacgattactctcgcatcgatctcatcccagttatctgtgacgccttacaacttcaagcttacgattattggtatttgttacttgccttcaggcattggagggctgattggatcttttgttacaggaaaagttattgacatctactacagaagagccctccggagatttgaagagaagaaggaacaaggtatcattcctatcgacagcaaattcaatactttaagggcacgtctattcacatcgattccccaaaacttcctcgcagtcatagcgtttacgctattcggatggagtgttgagagagggtggaatattgcggtgcctctaataacatcagcgattggctcgttctgtgcaatgagcaccttgtcatcgtccagtactttgctcgtcgatttgtaccccagcaaatcatctaccgcaacaagctgttacaatttcattcggtgctccttgagtgccatctttatggcctgtttgtccaaaatgaataacgccctcacagtcgggggaacattcactctcataagtggctttgttttcattggaaacttcgtcacactaatccctatgttctacggcatgaaatggcgtgagagaagagctctcagggccgagagagaaaagccataa

SEQ ID NO: 264 - protein, 551 aa, Kluyveromyces thermotolerans
MDNNSIHSSLSSESDLQSTMKLEKPVLGLEGDNTKKLLPQDAASRVTTREMRESSSDSRDRVESSGVNSKLPQGAPFTLLSHGQKWFMVALLTSAGFWSSLGSPIYYPALKQLEKKFNVSEEMVNITVVVYLIFQGIAPTISGGLADVYGRRPVILMGMLIYVCASIGLACSQSYGVIVFLRCLQSAGISPIIAINSGVVGDFTLKHERGTFVGAVSGFTLMGQAFGSLIGAALTAAFDWRAIFWFLTIGCGTCMIINFLILPETKRTLVGNLSIRPKRLINRAPILLLKSVRRKLHFDNPDYETLDPNKGKVDPISAFKIILHPEIILSLMPAGLQFALWTITLASISSQLSVTPYNFKLTIIGICYLPSGIGGLIGSFVTGKVIDIYYRRALRRFEEKKEQGIIPIDSKFNTLRARLFTSIPQNFLAVIAFTLFGWSVERGWNIAVPLITSAIGSFCAMSTLSSSSTLLVDLYPSKSSTATSCYNFIRCSLSAIFMACLSKMNNALTVGGTFTLISGFVFIGNFVTLIPMFYGMKWRERRALRAEREKP

SEQ ID NO: 265 - DNA, 1752 bp, Candida glabrata
atgatggaggatcagcaatcactgcatagtttcatatcggactatgatcaacggtcgcatgcggttgagaagtatgatggtcctgatctatctgaagttgacagtgaagacaatgataaaatgatcaagacgaatgaggacgaggctgtcaaagaacctatttacagaaccaggtccaaccagacagagcctgatatcgcaaatgcgccaccttattcgaggtttgacgctaaatataagatggctctggttttgcaatgtgcttacacgggtttattttcaacaatggcaggcgctatttactacccagtgctaagtgttattgagaaacagttccacattactgaagaattagtgaacataactgtggttgtttactttattttccaaggtattgcgccaactcttatgggtggactagccgattccttgggtcggagacctgtagttctgtttgctgtgacagtttactttggtgcatgcattggtttagcctgtgcccaaacctacgcacagattgttgtgctgaggtgtctacaggcagctggtatctctcctgtcattgccatcaatagtggtattattggagatgtgacgaccagggccgaaagaggggggtatgtcggatacatatcgggtttccaagttttaggtagtgcgtttggtgctctaattggtgccggtttgtcttcaaggtggggatggagatctatcttttggtttttagctataggctcgggtgtatgcttggtcttttcaataattatgctaccggaaaccaagagaaccattgtcggcaacggatcagttactcctcgtaactatcttaacagggctcctctactcatgtttcctctaatacgtaggaaattgcacttagacgatccagagtatgaaacactagaaccacgcacacaacttagccttttggcacctctttcaattttgaaagtcaaagagattagtattttgttggttactgctggtattcaatttgctacgtggtctactcatcaaacagctttgtcaacagttttaagtaaaaactatcatttatcagttgccaagattggtctatgttatttaccaactggtatttgtactttgataagtatcgtgacctctggtagatacttgaattggagttacagaaggagattcgctaaacacaaagtttggctaaaggaacaagaagaaattttagtgaaagaaaatggctacagtagagaggaagttcaaaacattattaataatgatccaaagtatgtctttaacctggtacaaactaggcttcacgctgctttcgttactctgttattgagtagtagtggatttgtcgcatttggatggtgcatcgatgttaaggcacctcttgcttcagtattggtaatgagtgggtttgcgtcgttgttttctaattgtatcttgactttctctacaacactcattgttgatattttcccttcaaagacatcaactgcaacaggatgtctgaacttattcagatgtttgctatctgctttgtttatcggctgtttgagtaaaatggctaccagtatgacctatggtggtgtttttacatttttgggtgctctaacagctctgtcggcttgtcctttattctacttgttgaagaatggtcgtgaaattactctcaagagaaagaggaaagaagatgctagcagagcatttgcattatctgtggcaaatgagaaggctgaggccgaaggaaaagccgaagaaagcagataa

SEQ ID NO: 266 - protein, 583 aa, Candida glabrata
MMEDQQSLHSFISDYDQRSHAVEKYDGPDLSEVDSEDNDKMIKTNEDEAVKEPIYRTRSNQTEPDIANAPPYSRFDAKYKMALVLQCAYTGLFSTMAGAIYYPVLSVIEKQFHITEELVNITVVVYFIFQGIAPTLMGGLADSLGRRPVVLFAVTVYFGACIGLACAQTYAQIVVLRCLQAAGISPVIAINSGIIGDVTTRAERGGYVGYISGFQVLGSAFGALIGAGLSSRWGWRSIFWFLAIGSGVCLVFSIIMLPETKRTIVGNGSVTPRNYLNRAPLLMFPLIRRKLHLDDPEYETLEPRTQLSLLAPLSILKVKEISILLVTAGIQFATWSTHQTALSTVLSKNYHLSVAKIGLCYLPTGICTLISIVTSGRYLNWSYRRRFAKHKVWLKEQEEILVKENGYSREEVQNIINNDPKYVFNLVQTRLHAAFVTLLLSSSGFVAFGWCIDVKAPLASVLVMSGFASLFSNCILTFSTTLIVDIFPSKTSTATGCLNLFRCLLSALFIGCLSKMATSMTYGGVFTFLGALTALSACPLFYLLKNGREITLKRKRKEDASRAFALSVANEKAEAEGKAEESR

SEQ ID NO: 267 - DNA, 1617 bp, Zygosaccharomyces rouxii
atgtgtacagacactgacactaaggttgtctttgatagctctcagaaagattcgaatagtctgaaaacgtcggatcagaaatctgacggttcactagcaggtaaagataatgaatcggagataccttattctagatttaaaagaagagataaactgttattagttgcacaatgtgcatcaacaggtcttttctcatcaatagcagcctccatctatttcccagttttaacaactgtggaaagaaaattccatattactgaagaacaggcaaatattacggttgtagtttactatgtctttcaaggactttcaccttcatttatgggaaatatggcagatactctaggtagaagaccagttatcttggtatctgttctaatttattttgtcgcctgtttagggattgcatcttgcaatacttattcacaattaattggtttaagatgcttgcaagccgccggaatttcacctgtaatcgccattaatagtggtatgatgactgatattacaactagggcggaaagaggcggttatgttggttacacttcaggctgtcaggtgcttggaagtgcatttggagccctaatcggagctggtctatcttcccgctgggggtggagatctgtattttggtttctatcaattggatctggtatatgtcttgtaatttcgactttactgttaccagagacaaagagaaccattgtgggcaatgcttccattacacctaggtcaattctcaacagatcaccgattctggcgattcccgccgtgagacgagaattacatttggataatccagatctacaaacgttagaaccatcaccaaagatgaatatcttggcatcttacaaaattttacttacacctgaaattgatctcttgctattcgttgcagggttacaatttgcaacatggactacccaccagacggcattatcgttaaatttgagtaaaaaatacaatttatcagtcgcaaaaattggtctttgcttcttaccttcaggaatatctacattactgagtgttgtattctcaggtagatttctaaattggaattacaagagaagattagcactacataataattggcttcaagaacaaaagaaacaattatttgaggaaaatgacaatgatattgatagagttaaccaccttttagcgactgatcctcgttaccatttcaatatctttcgcgccagattacaactggcattctttactttagtcttatcgagtggtggatttgcagcttttggttggtgtatccaagtaaaggcgccactagcggctgttttggttactagcggtttcgcctcacttttttccaactgtattttaaccatgtctacaacattagtcgtagatctcttcccttcaaaggcttcgactgcagcaggcttggttaatctgttcagatgcatgctctcagtagttttcattgcttcccttcataagatgtcttcaaaaatgaattacggtggtgtctttacttttctagcagcattgactgcatcttcatccgttctgctgttaataccagtgtcgaacggtaagactctttcttatagacgtcgtgaagaagagaggagattattagaagatgtcgagaattga

SEQ ID NO: 268 - protein, 538 aa, Zygosaccharomyces rouxii
MCTDTDTKVVFDSSQKDSNSLKTSDQKSDGSLAGKDNESEIPYSRFKRRDKLLLVAQCASTGLFSSIAASIYFPVLTTVERKFHITEEQANITVVVYYVFQGLSPSFMGNMADTLGRRPVILVSVLIYFVACLGIASCNTYSQLIGLRCLQAAGISPVIAINSGMMTDITTRAERGGYVGYTSGCQVLGSAFGALIGAGLSSRWGWRSVFWFLSIGSGICLVISTLLLPETKRTIVGNASITPRSILNRSPILAIPAVRRELHLDNPDLQTLEPSPKMNILASYKILLTPEIDLLLFVAGLQFATWTTHQTALSLNLSKKYNLSVAKIGLCFLPSGISTLLSVVFSGRFLNWNYKRRLALHNNWLQEQKKQLFEENDNDIDRVNHLLATDPRYHFNIFRARLQLAFFTLVLSSGGFAAFGWCIQVKAPLAAVLVTSGFASLFSNCILTMSTTLVVDLFPSKASTAAGLVNLFRCMLSVVFIASLHKMSSKMNYGGVFTFLAALTASSSVLLLIPVSNGKTLSYRRREEERRLLEDVEN

SEQ ID NO: 269 - DNA, 1767 bp, Ashbya gossypii
atggcggaagagaagttcgcacaggcatcagaggcgtccacgctggacgagttgaaaggccccaagctggccgccgctggtgagggccgcggtctgcggcatacccacagcagcacagaccaggaggcgcagtccgtagactggaactacgatggcaagcacgagggcatccggctcaagaaggacctgcaggcacgtcatgtgtcgatgatagccatcggcgggtcgctagggaccgggctgctgatcggcacgggcagctcgctgatgcgagcgggaccggggtcgatcctgattgcgtacagcatcatggggtgggtggtgttcacagtgatgtcgtgcctgggggagatggcggcgtacattccgctggacgggttcacgtcttacgccacccggtacgcggaccctgcgctgggctttgccgtggggtgggcgtatctgttcaaatacctggtgctcactcccaatcagctgacggcaggcgcgctagtgatacagttctggatacccgccgcacgggtcagcccgggcgtgtggataacggtggtgctggcggtcattgtcgtgattaacacggtgggggtgcgtttcttcggggaattcgagttctggctgtctagtttcaaggtgctggtcatgctgtgtgtgatgatcctgctgctcgtgctcgccctcggtggggggccgacccatgatcggctgggattccgctactggagtgaccctggagcattcaaagagtattcgaagaaagacacgcacattaagggcggcctcggcaagtttgtggccttcttgtcggtgttcgtgtatgccctctttgcctacctgggtaccgaactgtgcggtattgtcgctgcggagtgcaaagacccgcgccgcaacgtgccccgcgccatcaaactaacgctgtaccgtatcgtggtgttctacctcgtcaccatcttcctccttggcatgtgcgtcgcttataatgatccccttttgatgcaggcatctagtgccgaagtgtccgcggctgcatctccatacgtggtggcgatcgagaatgctgtcattcctgtccttccaaatctgttcaatgcctgtgtgctaacctttgtgttcagtgcctgcaattcggacctgtatgttggaagcagatccctttacggcctggcgatcgacgggaaggctcctaagctctttgccagaacgaacaaatggggtgttccgtacaacgcccttgcatgctgcacactgttctgctgccttgcatacatgagtgtctcgaagtctgccaggactgcatttggctacttcgtgaatgtcacatccatcttcgggctaatgtcgtgggtgtcgattctaatcacatacatttgttttgacagggctttccgtgcacaggggataccgaagtcgacactctcatacgtggcaccatgccaaccatatgcaggctgggtcgccctgattttctgcatcttcgtggccttgattaagaattttgatgccttcataggcaaggaggtagacgttccgaccttcatcacgggctacattgggcttccaatttacatattctgctttattggatacaaaatagtgcacaagacgaagtggataccgtcaaaggaagtggatctcttcacatttaaagaagctattgacttggaggaagaggagtgcatcagagagcgcgcattaatgaaggagcagcttgctaagggtgggttgtcatggaaaaagatatatgacaacgtgttaggatggatcttctga

SEQ ID NO: 270 - protein, 588 aa, Ashbya gossypii
MAEEKFAQASEASTLDELKGPKLAAAGEGRGLRHTHSSTDQEAQSVDWNYDGKHEGIRLKKDLQARHVSMIAIGGSLGTGLLIGTGSSLMRAGPGSILIAYSIMGWVVFTVMSCLGEMAAYIPLDGFTSYATRYADPALGFAVGWAYLFKYLVLTPNQLTAGALVIQFWIPAARVSPGVWITVVLAVIVVINTVGVRFFGEFEFWLSSFKVLVMLCVMILLLVLALGGGPTHDRLGFRYWSDPGAFKEYSKKDTHIKGGLGKFVAFLSVFVYALFAYLGTELCGIVAAECKDPRRNVPRAIKLTLYRIVVFYLVTIFLLGMCVAYNDPLLMQASSAEVSAAASPYVVAIENAVIPVLPNLFNACVLTFVFSACNSDLYVGSRSLYGLAIDGKAPKLFARTNKWGVPYNALACCTLFCCLAYMSVSKSARTAFGYFVNVTSIFGLMSWVSILITYICFDRAFRAQGIPKSTLSYVAPCQPYAGWVALIFCIFVALIKNFDAFIGKEVDVPTFITGYIGLPIYIFCFIGYKIVHKTKWIPSKEVDLFTFKEAIDLEEEECIRERALMKEQLAKGGLSWKKIYDNVLGWIF

SEQ ID NO: 271 - DNA, 1818 bp, Kluyveromyces lactis
atggctgaaaaggtttacttggacgcacagttgtccagagttgacacagacgaagatatcgaaaagcaacaattgtttggtgatgataacatagtaatcgagagatcttcgcaattattttacgatggtcaatctgatagcaaggttcatggtataacttctggtcatggttcggatgttaagaacgttgttactcatacgtcagaattcgatggtaaacatgatggtatcagattgaagaaagctctagaggctagacatgtttctatgattgctattggtggttcccttggtactggtcttcttatcggtacagggtcttctcttgcacttgcaggaccagctgccatccttatcgcttatgcgtttgtcggattgttggtgtttttcgttatgtcttgtcttggtgaaatggcagcttatatccctctagatgggtttacctcatattctactagatacgcagaccctgccttgggtttcgcagtcggttacgcatacttgttcaaatactggattatcgttcctaaccaattgaccgctggtgctcttgtcattcagtactgggtcgatcgtgacaaggtgaaccccggtgtatggatcactattttattggtcgctatcattacaatcaatttcttgggtgttagattctttggtgaaatcgaatactatatctctgcagtgaagattaccgtcatgctgggtcttatcattttgttgttggttcttgcatgtggtggtggtccaaaccatgaggtgttgggtttcaaatattggaaaaatccaggtgcattcaaagaatactctactgccatcactggtgctaagggtagattcgtgtcgttcgcttcggttttcgtgctagcccttttcgcttatttgggtactgaactatgtggtatcgttgtctctgaatgtaagaacccaagaaaagcggttccaaaggctatcaaattgaccatgtaccgtattatcgttttctacttgatttccatcttcttgcttggtatgtgcgtgccattcaatgatccattgttaattagcgctaagagtgccaagacatctgcatctgcatcgccatttgtcgttgccattgttaacgcaggtatcccagttttgccccacatcatgaatgcttgtattttgatctttgtgttttctgctgccaactctgatctttacgtggcttctagatccctttacggtttggcaattgataacaaggctccaagaatctttgctaagacaaacaaacaaggtgtgccatactggtcattactggtaggtgtcttatttgcattattagcatacatgaacgtttcttccggtagttctgaagttttcacatatttcgtcaattgtgtgtctatctttggtctactaagttggatctcaatcttgatcacatatatcagattcgacaaagctttcagggttcaaggtatcgataaatcaaccttggcttaccaatcgcctttgcaaccatatggagcttggttctccttattcttttgcattttgatcggtttgatcaaaaacttccctgcattcttaggtgacaccttcgactacaagtcattcatcactggttacattggtatcccaacttacatcatctcatacatcggttacaaattgtggtacaagaccaagatcatcccatccgaagaagttgatctcgtctcattcaaagaagcagtcgatttggaagaagaagaaggtaaaatgttagatgaggaaagagctgcacatcttgcagcacacggaaaggatctcaaatggtgctacgaaaagatcttcggctgggtcatgtga

SEQ ID NO: 272 - protein, 605 aa, Kluyveromyces lactis
MAEKVYLDAQLSRVDTDEDIEKQQLFGDDNIVIERSSQLFYDGQSDSKVHGITSGHGSDVKNVVTHTSEFDGKHDGIRLKKALEARHVSMIAIGGSLGTGLLIGTGSSLALAGPAAILIAYAFVGLLVFFVMSCLGEMAAYIPLDGFTSYSTRYADPALGFAVGYAYLFKYWIIVPNQLTAGALVIQYWVDRDKVNPGVWITILLVAIITINFLGVRFFGEIEYYISAVKITVMLGLIILLLVLACGGGPNHEVLGFKYWKNPGAFKEYSTAITGAKGRFVSFASVFVLALFAYLGTELCGIVVSECKNPRKAVPKAIKLTMYRIIVFYLISIFLLGMCVPFNDPLLISAKSAKTSASASPFVVAIVNAGIPVLPHIMNACILIFVFSAANSDLYVASRSLYGLAIDNKAPRIFAKTNKQGVPYWSLLVGVLFALLAYMNVSSGSSEVFTYFVNCVSIFGLLSWISILITYIRFDKAFRVQGIDKSTLAYQSPLQPYGAWFSLFFCILIGLIKNFPAFLGDTFDYKSFITGYIGIPTYIISYIGYKLWYKTKIIPSEEVDLVSFKEAVDLEEEEGKMLDEERAAHLAAHGKDLKWCYEKIFGWVM

SEQ ID NO: 273 - DNA, 1728 bp, Kluyveromyces polyspora
atgtcggtctatgaagtaacaaaggactcgaaattgataagagaagatattatcgatttagagaaaaatacaacatcgtcattgaactcatttgaacaagaggatgattcaaataaaattagtgatggtaaagaagatggcgtccgtcttaaaaaagagttgaaagctcgtcacatttcaatgatagcaatcggcggttctttaggtactggtcttttaatcggtactggtacagctttaagaactggcggtccagcttcaattttaatcgcttattcattcgtcggcattctagtattctttgttatggcttgtcttggtgaaatggctacttacattccattagatggtttcacaagttacgccactcgttactgtgatccagccttaggtttcgccgtaggttactgttatctgtttaaatatttcatcatcaccccaaatcaattaactgcaggtgctttagtaattcagtattggatagatagagaaactgttaatccaggtgtctggattactatcttcttggtagtaattgtcatcatcaacactgtaggtgtaagatatttcggtgaattcgagttttggttatcaagctttaaaatcatggtaatgttcggtgtaattctatttttattcattattatgttaggtggcggtccaaatcatgacagattgggtttcagatattggaaaaatccaggtgcttttaaaccttattccgaatctatcacaggctcaaaaggtaaattcgtttcattcgtcgcagtattcgtttatgctctgtttgcttatttaggtatcgaattaactggtatcgttgctgcagaagctgagaatccaagaagaaacatccctcgtgccatcaaattaacaatgtaccgtattatattattttacattgtcacgatctttttattaggtatgtgtgtcgcttacaatgatccaagactattagccgcggctcatgcttcaacttccgctgctgcctctccttttgtagtcgctatccaaaactctggtgtcagagcattacctcatattttcaatgtatgtgtcctgatattcgtctttagtgcttgtaattcagatctatacgttggaacaagaagtttatatagtctggcaattgatggtaaagctccaaaactttttgctaaaacaaatagatggggtgtcccttataatgctttgtttggttgcttcttgttctgtttattggcttatatgaatgtttcctcaggctctgctcaaattttcaactatttcgttaacgttgtctctatcttcggtattttaagttggatctcaatcttaattacttatatctttttctacagggcatgtattgcccaaaacgtcgacagaaattcttttgcgtacagagccccatttcaaccatatggtgcatacataactttgttcttctgtgttttaattgcatttatcaagaacttcacagtttttattggagaatttgattacaaatctttcataactggttacataggtttacctttgtatgttatcttctatttcggttacaagataatttacaaaacgaaattagtcaaagctgaagaagctgatttatattctttcaaagaagctattgatcgtgaggaggccgaaggtaaaattaaagaagcagaagcaaaagaaagactaaaaaattcaaagaaatctttgaaatggttctacgaaaagtacttgggttatatattttaa

SEQ ID NO: 274 - protein, 575 aa, Kluyveromyces polyspora
MSVYEVTKDSKLIREDIIDLEKNTTSSLNSFEQEDDSNKISDGKEDGVRLKKELKARHISMIAIGGSLGTGLLIGTGTALRTGGPASILIAYSFVGILVFFVMACLGEMATYIPLDGFTSYATRYCDPALGFAVGYCYLFKYFIITPNQLTAGALVIQYWIDRETVNPGVWITIFLVVIVIINTVGVRYFGEFEFWLSSFKIMVMFGVILFLFIIMLGGGPNHDRLGFRYWKNPGAFKPYSESITGSKGKFVSFVAVFVYALFAYLGIELTGIVAAEAENPRRNIPRAIKLTMYRIILFYIVTIFLLGMCVAYNDPRLLAAAHASTSAAASPFVVAIQNSGVRALPHIFNVCVLIFVFSACNSDLYVGTRSLYSLAIDGKAPKLFAKTNRWGVPYNALFGCFLFCLLAYMNVSSGSAQIFNYFVNVVSIFGILSWISILITYIFFYRACIAQNVDRNSFAYRAPFQPYGAYITLFFCVLIAFIKNFTVFIGEFDYKSFITGYIGLPLYVIFYFGYKIIYKTKLVKAEEADLYSFKEAIDREEAEGKIKEAEAKERLKNSKKSLKWFYEKYLGYIF

SEQ ID NO: 275 - DNA, 1746 bp, Saccharomyces kluyver
atgtcctttatccaagacagttatcgtaaggatctggagaaaatcgtctccaactcaaacaccacatctaaggatgtcgaaaatttggacctttccaaccaagatgatatctcatctcaagaatcccatttaaatattgacggtaagcatgacggtatccgtttgaaaaaagaattggaagcccgtcacgtttctatgattgccatcggtggttctttgggtaccggtttgttgattggtactggtacctccctttcccttgctggtcctgtttctattttgatcgcttactcctttgtcggtttcttggtctacattgttatgacatgtcttggtgagatggccacctacattccattggatggtttcacaagttatgcatcccgttactgtgacccagctttgggttttgccgttggttattcctaccttttcaaatacctgatcattacaccaaatcaattgaccgctgccgctttggtcttgcagtactgggtgtccagagagaaggtcaacccaggtgtctggattaccattttcctggttattattgtcacgatcaacgttgtaggcgtcaaattctttggtgaatttgaattttggctatcgagtttcaaagttcttgtcatgctgtgtctgatcgttctgctatttgttataatgttgggtggtggcccatcccatgaccgtttgggtttcaggttttacaaggatccgggtgcgttcagaccttattcagaagccatcagtggttccaagggtaaatttgtctcttttgtcgcagtctttgtttacgctttgtttgcatacttgggtaccgaattgtgtggtattgtcgctgcagagtgtaagaacccaagaagaaacgttcctcgtgctatcaagttgacgctgtaccgtatcgttgttttctaccttgtcaccatcttcttgttgggtatgactgtcgcttacaacgatccattgttgctacaagccaagaagaagtctacttctgccgctgcttctcccttcgtcgttgccatcaagaatgcaggtatcccagttttgccacacatcttcaacgcatgtgttttgatgttcgttttcagtgcttgtaactcggacttgtacgttgcttctagaagtttgtacgggttggccattgacaacaaggcaccaaagattttcgccaagactaacaagtggggtgttccatacaactctttgatcttgtgtatcctgttctgtctattggcttatatgaacgtgtcttctggttccgctcaagtcttcaactatttcgttaacgttgtgtctatctttggtttgatgagttggatcgccattttgattacctacatctacttcgacagggctttaagagcacaaggtgtggataaatctacgctagcttatgccgcaccactagcatccaaaggtgcttatttcgctttgtttttctgctgtttgattgctttgattaagaatttcaccgtatttttgggtcacaaatttgactacaagaatttcatcaccggctatattggtatcccagttttcatcatctgtttctttggttacaaatacatccgtggtaccaaattcgttaaaccagaggaagctgacttgtacactttcaaagaacttatcgacttggaagaagaagaaggtaagctttgggacgctgcacaaaaggaaaagatggaaagctctccaaagaacttcaaatggttttacgaaaagtttttgggctggatcttttaa

SEQ ID NO: 276 - protein, 581 aa, Saccharomyces kluyver
MSFIQDSYRKDLEKIVSNSNTTSKDVENLDLSNQDDISSQESHLNIDGKHDGIRLKKELEARHVSMIAIGGSLGTGLLIGTGTSLSLAGPVSILIAYSFVGFLVYIVMTCLGEMATYIPLDGFTSYASRYCDPALGFAVGYSYLFKYLIITPNQLTAAALVLQYWVSREKVNPGVWITIFLVIIVTINVVGVKFFGEFEFWLSSFKVLVMLCLIVLLFVIMLGGGPSHDRLGFRFYKDPGAFRPYSEAISGSKGKFVSFVAVFVYALFAYLGTELCGIVAAECKNPRRNVPRAIKLTLYRIVVFYLVTIFLLGMTVAYNDPLLLQAKKKSTSAAASPFVVAIKNAGIPVLPHIFNACVLMFVFSACNSDLYVASRSLYGLAIDNKAPKIFAKTNKWGVPYNSLILCILFCLLAYMNVSSGSAQVFNYFVNVVSIFGLMSWIAILITYIYFDRALRAQGVDKSTLAYAAPLASKGAYFALFFCCLIALIKNFTVFLGHKFDYKNFITGYIGIPVFIICFFGYKYIRGTKFVKPEEADLYTFKELIDLEEEEGKLWDAAQKEKMESSPKNFKWFYEKFLGWIF

SEQ ID NO: 277 - DNA, 1794 bp, Saccharomyces castelli
atgacaatcagagaagtactcacagaagaaacaacttccgatcgctacgaagaatacttcgacccacaaaagaaggtcgattcaaagactttccccacccaggaacgtgaactgcttcacgatgacttggaaaataatatctcactctctacaagtgcagaagaccaaaatgactcttataacgtcgatgggaagaccgaaggaacaagattgaaaaaagttctggagggaagagtcgtttccatggtcgccattggtggtagtttgggtactggtctattaatcggtacaggtaactctttggctactgccggtccagtttctatgctaatcgcctacgcctttgtcggtctattagtgttcttcactatggcctctttgggggaaatggcttcttatatcccattagatgggttcacaagttatgctactcgttatgctgatcctgcccttgggttcgctgtgggttattgctaccttttcaaatattttatcttacctccaaatcaattaaccgccgctgcattagtcattcaatactggatcccaagagaaaaagttaaccctggtgtttggattaccatcttcttagtcgtcatcgtcgccattaatacactaggtgttcaattctttggtgaattcgaattctggttatccagtttcaaagtccttgtcatgttcgccttaatcatcttattattcatcttaatgttaggtggtggtccaaatcatgacagattgggattcagacactggaaacatccaggtgcattcaataattattctccagcaattacaggcgacacaggtaaatttgtcgctttcgtttccgtctttgtctacgctactttcgcttacttaggtactgaattggttggtattgtcgttggtgaagctagaaatccaagaaaaagtgttccaaaggctattaaattgaccatgtaccgtatcatcattttctatttaattagtatcttactattgggaatgtgtgtcgggtatgatgacccacttttattagaagctaagaccaagagtacctcagctgctgcctctccatttgtcgtcgccatcgttaactcaggaattaaagtgttaccacacatctttaatgcatgtgtcttagtctttgtcttcagtgcttgtaactcagatttatacgtcgcttccagaagtttgtacagtttagccatcgataacaaggctcctaaaatttttgcaagaactaacagatgggggattccatattattccctcgggttatcagtcctattctgtcttttagcatacatgagtgtttcctctggttccgctaagatcttcaactatttcgtcaatgtcgtttccatctttggtttattaagttggatttgtatcctagtcacttatttggcattcgacagagccgtcagagcacaaggtattgataaatccactttttcatacgtcgctccaggtcaacgttatggtgcttatttcgctttgttcttttgctctttaatcgctttgattaaaaactttactgtctttttaggtcatcaatttgattacaagactttcattacaggttacattggtataccagtctttttcatctcttactttggttataaactcatttataagactaagattattgacccattagaagtggatctttacactttcaaagctgccattgatcaagaggaagaagatgggaaattggaagacattgctagaaaggaaagaataaaggctaacggaagaaatttcgaatggttctacgataaattcttaagcaatatcttttaa

SEQ ID NO: 278 - protein, 597 aa, Saccharomyces castelli
MTIREVLTEETTSDRYEEYFDPQKKVDSKTFPTQERELLHDDLENNISLSTSAEDQNDSYNVDGKTEGTRLKKVLEGRVVSMVAIGGSLGTGLLIGTGNSLATAGPVSMLIAYAFVGLLVFFTMASLGEMASYIPLDGFTSYATRYADPALGFAVGYCYLFKYFILPPNQLTAAALVIQYWIPREKVNPGVWITIFLVVIVAINTLGVQFFGEFEFWLSSFKVLVMFALIILLFILMLGGGPNHDRLGFRHWKHPGAFNNYSPAITGDTGKFVAFVSVFVYATFAYLGTELVGIVVGEARNPRKSVPKAIKLTMYRIIIFYLISILLLGMCVGYDDPLLLEAKTKSTSAAASPFVVAIVNSGIKVLPHIFNACVLVFVFSACNSDLYVASRSLYSLAIDNKAPKIFARTNRWGIPYYSLGLSVLFCLLAYMSVSSGSAKIFNYFVNVVSIFGLLSWICILVTYLAFDRAVRAQGIDKSTFSYVAPGQRYGAYFALFFCSLIALIKNFTVFLGHQFDYKTFITGYIGIPVFFISYFGYKLIYKTKIIDPLEVDLYTFKAAIDQEEEDGKLEDIARKERIKANGRNFEWFYDKFLSNIF

SEQ ID NO: 279 - DNA, 1734 bp, Kluyveromyces thermotolerans
atgtccgagtctctagagaagaaaaatgctgggatattatacagcaacgagacccttgaggaggatgtcgcctttgacaaactcgagcgcggcgccagcggcgccagcgccgcgggcgcgtctgtggacggcaaacacgaaggcatccggctgaagaaagcgcttgaggcgcggcacgtgtcgatgatcgccatcggcgggtcgcttggtaccgggctgttgatcggcacaggtagctctctggccagcgcgggccctgcgtcaattttgatttcgtacagtttcgtgggcctgttggtgtacacggtgatggcgtgtctcggagagatggccgcgtttattccgctggacggcttcacatcgtacgcgtcgcgttacgtcgaccccgcgttgggcttcgcagtcgggtactgctacctgttcaagtatttcattgtgacgcccaatcagctgaccgcaggcgccatggtgatgcagtactgggtctcgcgtgaaaaggtcaacccgggcgtgtggatcacgattttccttgttctcattgtgctcatcaacacggtcggtgtgcgcttcttcggcgaattcgagttctggctgtccagtgtcaaggtcctggtcatgctggggctcatcctgctgctgtttatcatcatgctcggtggcgggcccaaccacgaccgcaccggcttccgctactggcgcgaccctggtgcgttcaagccctactccgaagccatctcgggctccaagggcaagttcgtgtcttttgcttccgtgttcgcgctcgccttgttcgcttacaccggtaccgagctgtgtggtatcgtcgccgccgaggctaagaacccacgtcgcagtgtgccccgcgccatcaagctgaccctctaccgtatcgtgctcttctacgtcatctccattctgttgctaggaatgaccgtcgcctacaacgacccactactgatcaaggccaagaagatgtccacctccgcggctgcctcgccttttgttgtggctatcaagaacgctggcattcctgtcctgcctcacatcttcaacgcttgtgtgctgctctttgttttcagtgcctgtaactcagacctttacgtcgcctccagaaccctttacggtctggccatcgaccgcaaggctccaaaaatctttgccaagactaacggctggggtgtgccatactactcgctcgcggtctctgtcctgttctgtctccttgcgtacatgaatgtctcctcaggttccgctcagatcttcaactacttcgtcaatgtcgtcagtatctttggtctgttgagttggatctccatccttatcacctacctgcgtttccacaaggctgtcatcgcccaattcggcgacaagtctggtttctcttacacggcaccattccaaccttggtctacctgggtgtccttgttcttctgctgcctcatcggtctcatcaagaactacacggtgtttctgggccacacgtttgactacaaaaccttcatctccggttacatcggcatccctgtctacgctatctgctacgtgggctacaaattggtgcaccgctcgaagctaattaaaccagaggacgtcgacctctacacattcaaagctgcgatcgacgcggaggaagaagaaggtaagctgctcgagctcgagcgcaaagaacagctcaaaagctctccaaagaacctcacatggttttacgacacctttttgggctggattttctaa

SEQ ID NO: 280 - protein, 577 aa, Kluyveromyces thermotolerans
MSESLEKKNAGILYSNETLEEDVAFDKLERGASGASAAGASVDGKHEGIRLKKALEARHVSMIAIGGSLGTGLLIGTGSSLASAGPASILISYSFVGLLVYTVMACLGEMAAFIPLDGFTSYASRYVDPALGFAVGYCYLFKYFIVTPNQLTAGAMVMQYWVSREKVNPGVWITIFLVLIVLINTVGVRFFGEFEFWLSSVKVLVMLGLILLLFIIMLGGGPNHDRTGFRYWRDPGAFKPYSEAISGSKGKFVSFASVFALALFAYTGTELCGIVAAEAKNPRRSVPRAIKLTLYRIVLFYVISILLLGMTVAYNDPLLIKAKKMSTSAAASPFVVAIKNAGIPVLPHIFNACVLLFVFSACNSDLYVASRTLYGLAIDRKAPKIFAKTNGWGVPYYSLAVSVLFCLLAYMNVSSGSAQIFNYFVNVVSIFGLLSWISILITYLRFHKAVIAQFGDKSGFSYTAPFQPWSTWVSLFFCCLIGLIKNYTVFLGHTFDYKTFISGYIGIPVYAICYVGYKLVHRSKLIKPEDVDLYTFKAAIDAEEEEGKLLELERKEQLKSSPKNLTWFYDTFLGWIF

SEQ ID NO: 281 - DNA, 1842 bp, Candida glabrata
atgactaccacgctgtctgtaccacctgtgttctctgagaaccactcgatggtctcgctgggcgcctctgactcgcgcgggcaccacttgactgaacacactcaccatgaacaccatgtgaaccacgttaaccacgacaagaaggacggtctggacatcaacgacatggacaacctgtccacggtctcgtcccgtctggaggactctgagaagcaagacgactacatggacgatggtaaggacgagcacaccagactgcgcaaggacctgaaggcgcgccacatctccatgatcgccatcggtggctccatcggtacgggtctgctgatcggtactggtaactcattgtatacggctggccccatgtcgatgtttatcgcctacgccttcgttggtgtgctggtgttcttcaccatggccgccctgggagagatggcctcttacatcccactagatggtttcaccagttacgcctccagatactgtgacccagctctgggtttcgccgtcggctacgcatacttgtgtaagtacctgatcttgcctccaaaccaattgaccgctgcagctctggttatccaatactggctagaccgtgagcaggtcaaccctggtgtatggatcaccatcttccttgttatcatcgtcgccatgaacttcatcggtgtcaaattcttcggtgaattcgagttctggctatccactttcaaagtcatcgtcatgatcggtctgatcatcttgctgtttgtgatcatgcttggtggtggcccaacccacgaccgtttgggtttcagattctacgaccatccaggtgccttcaaaccatactcaaagtccatcgacggctccaagggtaagttcgtcgccttcgtcgccgtgctagtttacgccttgttcgcctacttgggtattgaattgactggtatcgtcgccgcagaagcagcaaacccaagaaagtccattccaaaggccatcaaactaacaatgtaccgtatcatcgtcttctatttggtcaccatcttcctgctaggtatgtgtgtcgcatacgatgacccattgctaaagaaggccaagacctcaggtactggtgctgctgcttctccatacgttgtcgctattatcaactccggtatcaaggccctacctcacatcttcaacgcctgtgtgctaatgtttgtcttcagtgcatgtaactctgacttgtacgtcgcttccagaaccctttacggtttggcaatcgacaacaaggctccaaagatattcgccgtcaccaacagatggggtgtgccatactactcgcttctaatgagttcctgcttctgtctattggcatacatgagtgtctcctccggttccgccaagatcttcaactacttcgttaatgttgtctccatcttcggtctattaagttggatcagtatcttgatcacctacctttgcttcttcagagctgtcaaggcccaaaatgtcgacagatccagattcgcttaccgtgctccattccaaccatacggttcttacttcactctagctttctgtattttgattgccttcattaagaacttcaccgtcttcttgaaccaccacttcgactacaagaatttcatcactggttacatcggtatcccagtgttcgtgatctcttacttcggctacaaattcgttaagaagactaagatctggaagccagaggaagtcgatctatacactttcaaggctgccatcgatgaagaagaagaacaaggtaagatcgctgacgctgaaaggagagaaagattgaagaacagtaagactaagggatgggactggttctacgaaaaggtccttggtaacatcttctga

SEQ ID NO: 282 - protein, 613 aa, Candida glabrata
MTTTLSVPPVFSENHSMVSLGASDSRGHHLTEHTHHEHHVNHVNHDKKDGLDINDMDNLSTVSSRLEDSEKQDDYMDDGKDEHTRLRKDLKARHISMIAIGGSIGTGLLIGTGNSLYTAGPMSMFIAYAFVGVLVFFTMAALGEMASYIPLDGFTSYASRYCDPALGFAVGYAYLCKYLILPPNQLTAAALVIQYWLDREQVNPGVWITIFLVIIVAMNFIGVKFFGEFEFWLSTFKVIVMIGLIILLFVIMLGGGPTHDRLGFRFYDHPGAFKPYSKSIDGSKGKFVAFVAVLVYALFAYLGIELTGIVAAEAANPRKSIPKAIKLTMYRIIVFYLVTIFLLGMCVAYDDPLLKKAKTSGTGAAASPYVVAIINSGIKALPHIFNACVLMFVFSACNSDLYVASRTLYGLAIDNKAPKIFAVTNRWGVPYYSLLMSSCFCLLAYMSVSSGSAKIFNYFVNVVSIFGLLSWISILITYLCFFRAVKAQNVDRSRFAYRAPFQPYGSYFTLAFCILIAFIKNFTVFLNHHFDYKNFITGYIGIPVFVISYFGYKFVKKTKIWKPEEVDLYTFKAAIDEEEEQGKIADAERRERLKNSKTKGWDWFYEKVLGNIF

SEQ ID NO: 283 - DNA, 1830 bp, Saccharomyces bayanus
atgaagatgatgtctctaaagaagatgcttacgagcgcatcgtcccgtaactcttcttctcttgataatgatcgcgatggttactctatgaaacaaaatccagacaagttccccgtaaaggaacaagaaatatataacatcgatctggaggaaaacaatgtatcctctcgttcatccacctccacatcaccttctgcaagggacgattcgttcgccgtcccggacggtaaagatgagaccacgagactaagaaaagatttgaaggcaagacatatttctatgattgccattggtgggtcgctggggactggtctgcttattggtacaggtaccgctttattaactggggggcccgtatccatgctgattgcatacggctttgtcggtcttctggttttcttcaccatggcttgtcttggtgaaatggcttcttacatcccattggatggtttcacgagttatgcttcacgttatgtggatcctgctttagggtttgccattggttatacttaccttttcaaatatttcatcttacctccaaaccaacttactgccgctgctttggtcattcagtattgggttagcagagaccgtgttaatcctggtgtatggatcactatctttttggtggtaattgtggctattaacatcgttggtgtgaggttctttggtgaatttgaattctggctatctagtttcaaagtcatggtgatgttgggacttatcttactactgttcatcattatgcttggtggtgggcccgaccatgatcgtttaggattcagatactggcgcgatcctggcgctttcaaggaatattcgacagccatcaccggtagtaaggggaaattcgttgcctttgcttcggttttcgtctacagtcttttcagttataccggtattgaattgaccggtattgtttgttccgaagctaagaatccaaggaaaagtgttccaaaggcaatcaagttgaccgtttaccgtatcattgttttctacctgtgtaccgttttccttttgggtatgtgcgtggcgtacaacgatcctcgtttactatctacaaagggtaaagctatgtcagcggcagcatctccatttgtggtggccattcaaaattcaggcattaaagttctacctcatattttcaacggttgtgttcttgttttcgtcttcagtgcctgcaactcggatttgtacgtttcttccagaaacttgtacgcattggccattgatggtaaggcacccaagatcttcgctaagaccagcaaatggggtgttccttactacgccttgatggtttccgtgttgttttgttgcttggcgtatatgaatgtgtctgccggatcagcaaagattttcaattatttcgttaatgttgtctctatgtttggtatcttaagttggatcaccatcctaatcgtttatatctatttcgatagagcttgccgtgcacaaggggttgataagtcgaagttcgcttatgtcgctcctggtcaacgttacggtgcttactttgccctattcttttgtattttgattgctttgatcaagaatttcacagttttcctcggccatacttttgattataaaactttcatcactgggtatatcgggttgcctatttatgtcttttcatgggttggatacaagttgatttataagaccaaagtggttaagccagcagacgcggatctatacaccctcaaagaaatctacgatagagaggaagagcaaggcaaactacaagaccaagaaaaggaggaacgtttgcaaagaaacggtaaaaacctggaatggttttatgagaaattcttgggcaatatcttctag

SEQ ID NO: 284 - protein, 609 aa, Saccharomyces bayanus
MKMMSLKKMLTSASSRNSSSLDNDRDGYSMKQNPDKFPVKEQEIYNIDLEENNVSSRSSTSTSPSARDDSFAVPDGKDETTRLRKDLKARHISMIAIGGSLGTGLLIGTGTALLTGGPVSMLIAYGFVGLLVFFTMACLGEMASYIPLDGFTSYASRYVDPALGFAIGYTYLFKYFILPPNQLTAAALVIQYWVSRDRVNPGVWITIFLVVIVAINIVGVRFFGEFEFWLSSFKVMVMLGLILLLFIIMLGGGPDHDRLGFRYWRDPGAFKEYSTAITGSKGKFVAFASVFVYSLFSYTGIELTGIVCSEAKNPRKSVPKAIKLTVYRIIVFYLCTVFLLGMCVAYNDPRLLSTKGKAMSAAASPFVVAIQNSGIKVLPHIFNGCVLVFVFSACNSDLYVSSRNLYALAIDGKAPKIFAKTSKWGVPYYALMVSVLFCCLAYMNVSAGSAKIFNYFVNVVSMFGILSWITILIVYIYFDRACRAQGVDKSKFAYVAPGQRYGAYFALFFCILIALIKNFTVFLGHTFDYKTFITGYIGLPIYVFSWVGYKLIYKTKVVKPADADLYTLKEIYDREEEQGKLQDQEKEERLQRNGKNLEWFYEKFLGNIF

SEQ ID NO: 285 - DNA, 1557 bp, Zygosaccharomyces rouxii
atgcttgaaaagaagggtacagttgttttagaaaggcctgcatctggggaagatgagtgtgaatctgaggaaattgacgaaaagaatgggaacctttctcgggaactcaaaccaagggtggtatccctcttgacgctggggagtgctgttggcactggccttattattggcagtggatcggcgttggctaaaggaggccccataagcctttttatagcgtacctgtttactggttcactgctgtgcgtggtcatcttttctttgagcgagatggcaagctttgcgccaatggacaaaggattcagtggatatctgaacagatacgtcgacccagcgtttggattcgcagctggttggaattattttcttaaatatgcaattgtgttgagtgcaaatttaactgcctttggattggttataggatattggaggccagacgtaaacgtcggagtgtgggttacagttctttatgtgacagtgttttgtgtaaattttttggcggtcaagtattttggagagattgaagccttgctgactgtgtttaagttgctagtgctggtgatcgtttatatcacttgcctaatcatcacttgcggcggagccccgaatcatactactactggatttcgttattggcgtgagagcggcgcacttccctatctagttggaggcggcacgggaaaatttcttggttggtgggcttgtgttgttcagtcaatatttgggtttatgggatctgaaatgattggtatagtttatggagaaactgcgaacccgaaaaagactattcccaaatcctctatgaatgtgttttttcgaattggatttctttacgtttttggagtattcatactggggttggcaatatcaccagtcaattcaaaattggttcatgcccatagcacggatgccaatgcttctccgtttgtgattgcaataagttcaagtggaatcaaagttttgcccaacttcgttaatgctgcattattagtgttcatcatcagctctgcaaatacggatatttatatatgttcgaggcaactttatggattggccaaggatggggcagcacccaaaatatttttgcttgtgaacaggttcaaggttcccgtagttgggtgtgtcacaggttctttactagggtttttggcttatatgaatacgaagaaatcggcggcaacggtctttagttacataaccagcacagtttcggtatttggtattttaaattggttctacatcctaatagcttatatcaactacgatcgggcgataaaggcaaaaggaataagtatcgatgatattcccttccgtatgtggtttcagccatatgctgcgtacgtgacacttttctttgtgacgatcattactttttttaatgggtacaacgccttcatcataaaatttcactacaagactttcatcacaagctatattggagtatttgcaaatattttaatggtgataggatacaaactatactttaagacaaaattcgtaaaaccaagtgaaatctcctttagaacaaggaacgaacatgaaggtgaggaagcttaa

SEQ ID NO: 286 - protein, 518 aa, Zygosaccharomyces rouxii
MLEKKGTVVLERPASGEDECESEEIDEKNGNLSRELKPRVVSLLTLGSAVGTGLIIGSGSALAKGGPISLFIAYLFTGSLLCVVIFSLSEMASFAPMDKGFSGYLNRYVDPAFGFAAGWNYFLKYAIVLSANLTAFGLVIGYWRPDVNVGVWVTVLYVTVFCVNFLAVKYFGEIEALLTVFKLLVLVIVYITCLIITCGGAPNHTTTGFRYWRESGALPYLVGGGTGKFLGWWACVVQSIFGFMGSEMIGIVYGETANPKKTIPKSSMNVFFRIGFLYVFGVFILGLAISPVNSKLVHAHSTDANASPFVIAISSSGIKVLPNFVNAALLVFIISSANTDIYICSRQLYGLAKDGAAPKIFLLVNRFKVPVVGCVTGSLLGFLAYMNTKKSAATVFSYITSTVSVFGILNWFYILIAYINYDRAIKAKGISIDDIPFRMWFQPYAAYVTLFFVTIITFFNGYNAFIIKFHYKTFITSYIGVFANILMVIGYKLYFKTKFVKPSEISFRTRNEHEGEEA

SEQ ID NO: 287 - DNA, 1731 bp, Kluyveromyces waltii
atgaactcggatacttccatggaaaagaaaaacgcaggcgtgctctacagcaacgagacgctggaagagggcattgtaacgctggaaagcgaaggccaggtgcgcagtgtgtcggagggcgttgatggtaaacacgagggcatcagactgaagaaagaactggaggcacgtcacgtgtcgatgattgcaattggtggatcgctcggtacgggtctgctcatcggtaccggtagctcgctcgccagtgcaggtcccgtctcgatccttatctcgtactcgttcgtcgggcttttggtctacacagttatgagctgtctgggtgagatggctgccttcatcccgctggacgggttcacctcgtacgcctcccggtacgtggaccctgcagtcgggttcgccgttggatacagttatttgttcaaatatttcattgtgacgcctaaccagcttactgcgggcgccatggttatgcaattttgggtttcacgcgaccgcgtgaaccccggtgtgtggattacgatcttcctggcgctgatcgtgcttatcaacactgtgggtgtgagatttttcggtgaatttgaattctggttgtcaagtgtcaaggtcctggttatgcttgggctgatcttgctactgttcattatcatgttgggtggtggtccaaaccacgaccgtactggtttccgtttctggcgcgacccaggtgctttcaagccttactctgaggccatctccggctccaagggtaagttcgtttctttcgcctctgttttcgccctcgctcttttcgcctacactggtactgaactttgtggtattgtcgccgctgaggctaagaacccacgtagaagtgttcctcgtgccatcaagcttaccttgtaccgtattgtggtcttctacgtcatcaccattcttcttctaggaatgaccgtggcttacaacgacccccgtctgctcaaggccaagaagatggccacttctgctgctgcctcaccattcgttgttgccattgaaaacgcctccattccagtgctacctcacatcttcaacgtttgtgttctggtttttgtcttcagtgcttgcaactccgacttgtacgttgcttccagaagtttgtatggtctagccatcgacggcaaggctccccgcattttcgccacaaccaacaaatggggtgttccttactactccctaggtctgtccgtgctattctgtctgcttgcttacatgaacgtgtcttccggttctgcccaggttttcaactacttcgtgaacgttgtgtccatcttcggtcttctcagttggattaccattctgatcacctacattcgctttgacaaagccatcagagttcaattcggtgacaagtcttcgctttcatacactgctgcattccaaccatggtctacctacgttgctctattcttctgctgtctcatcggtttgattaagaactacaccgtcttcctgggtcacaagttcgactacaagacttttatttctggttacattggtatccccgtctatctaatctgctacgtcggttacaaggttgtttaccgtaccaagttgatcaagccagaggacgtggatctgtacacattcaaagacgctattgacgctgaggaggaggaatacaagctactagaaaaagagcgtcttgaaaacatggagaactcgcccaagaacttcaaatggttctacgaaaccttcttgggatggatcttctaa

SEQ ID NO: 288 - protein, 576 aa, Kluyveromyces waltii
MNSDTSMEKKNAGVLYSNETLEEGIVTLESEGQVRSVSEGVDGKHEGIRLKKELEARHVSMIAIGGSLGTGLLIGTGSSLASAGPVSILISYSFVGLLVYTVMSCLGEMAAFIPLDGFTSYASRYVDPAVGFAVGYSYLFKYFIVTPNQLTAGAMVMQFWVSRDRVNPGVWITIFLALIVLINTVGVRFFGEFEFWLSSVKVLVMLGLILLLFIIMLGGGPNHDRTGFRFWRDPGAFKPYSEAISGSKGKFVSFASVFALALFAYTGTELCGIVAAEAKNPRRSVPRAIKLTLYRIVVFYVITILLLGMTVAYNDPRLLKAKKMATSAAASPFVVAIENASIPVLPHIFNVCVLVFVFSACNSDLYVASRSLYGLAIDGKAPRIFATTNKWGVPYYSLGLSVLFCLLAYMNVSSGSAQVFNYFVNVVSIFGLLSWITILITYIRFDKAIRVQFGDKSSLSYTAAFQPWSTYVALFFCCLIGLIKNYTVFLGHKFDYKTFISGYIGIPVYLICYVGYKVVYRTKLIKPEDVDLYTFKDAIDAEEEEYKLLEKERLENMENSPKNFKWFYETFLGWIF

SEQ ID NO: 289 - DNA, 2232 bp, Kluyveromyces waltii
atgtcgggtcctgaaatgttacaagtcacaagactagaacgctcaccagagcgcgcgcgctctggtgaacgttctgtcattgtgggtgtagcggccaccgatttacggctgtctcaacccactccactggattctccgactacaagtgccggcaggccaaaacgcaacacttttgcttgcacaaactgccacgcgcagaaatctaaatgcgtgccctctgatgtgctggatatttatcgtaaaccctgcgtacgatgtcggaaacgaaacaagctgtgcacatttgacttgtcacgccggacgaggaggcggcatcggaattctagctccagctccaatgccagtgtgccggtgacacctgctgacgtaaccaccccggccattggtgaggccgagactaacagtgcggagagtgatacagccgcgccagctgcggcgccagctgcgatgccagcagtggtgccaccaacgggaaatttagatgcatcaccaacagcgtctgcaccttcccttcgtcaagagctccaactattgctggcttctcaatgcgacaatctaaatctcatttccgaacggctgtccaaactttccgaaaaatggaactctgtgatcgaaaacagtttcggcgtgtcactggcgctcgatccagtatcgctggggctgctcacttctgaacaggcccagtataggctcgatctgtatcgttccgagatttcgagcaaataccggtttcccttcgtgaaaatcccagggtacctgtccttggaccgcttccgtgaacaagagcctattttgtttgtcaccatcatggctatcgtttcgccaatgctcaaagataaccaagccgacgatgaccaaaatatgaaattggacaattttgccctgggtgtcatttccaaccacatgatgagactgggcaacaaatctttggagctgctgaaatccctactaaccctgtgcatgtggtacaatttcccagaatggttcaacaaaaccagattccattttttcaactacatctgctgctgtctgattcgagacctaatcccggttaaacgcccacgttctttcgcgattccccgagaggatgacacggccgccattgacgcatttttactacagaacccaagctactctcgccttgtaattctcgtttatgtgtccgctttgaacatcaacatttttcttcgccaacccatacaaaacaagtggggtcacctgcaagaccgggcatgtcgcattatgtccctattcgatgtggattccaattccctgtacaatcgtgaagaagatgaaatactcttcacgtttgctaagttaaatcgcatactcgaaaccatccacataaaactgcatgagactgaagatgagccacttgatccacaggacggcttggcccctctagcgcaaatcaatctagcatcgtctttacaaatggaactgcaaacaatttacagtcagatccctcctaagagggtgcgtgctctagccttctatcactccgtcgaagcttacctccacgagtggcttttttccaggtttatggcaaggttcccagatcattccgtcatcaaagagttaccagcagcggtttctgaatccttccgaaactttaccaagtcttgcatgagcgcaatgcacgagtttctaaagctgtcacccgaacttattgcatctctgccgctatttcacatttcgagagttatttacacagtcggaatgttactaattcgcgtaagatatacctccatgacagtcccagcgtttgcgctctataaagaactatcacaacctgcaatttcacttgtaaggcagatatcagaatctttgaatgaaagtgcggcattgtttccctacaacaactttctttcaaaactgcgatatgttgttgcactttttgtccaaatatacgccaacaagatgaaagtttatgtgaaaaattcaaagagtgacgcagaatgcttgaatcatcctgctgcatatggagcaagtgaaatggttcctgttcctcatcaaagctccgttccaatgctactgaacccagtttcgccgccccacgatagcgcttcagtaccagaagtaccgcaaaacgtggatacatccgctacagaactttcgagtaaaatagccgatgagcttccttatcagctggctgatatgagttctttagaatatggtatttctgctcttaatgatgagttttggaccgatgtttttttaggcgccatgtaa

SEQ ID NO: 290 - protein, 743 aa, Kluyveromyces waltii
MSGPEMLQVTRLERSPERARSGERSVIVGVAATDLRLSQPTPLDSPTTSAGRPKRNTFACTNCHAQKSKCVPSDVLDIYRKPCVRCRKRNKLCTFDLSRRTRRRHRNSSSSSNASVPVTPADVTTPAIGEAETNSAESDTAAPAAAPAAMPAVVPPTGNLDASPTASAPSLRQELQLLLASQCDNLNLISERLSKLSEKWNSVIENSFGVSLALDPVSLGLLTSEQAQYRLDLYRSEISSKYRFPFVKIPGYLSLDRFREQEPILFVTIMAIVSPMLKDNQADDDQNMKLDNFALGVISNHMMRLGNKSLELLKSLLTLCMWYNFPEWFNKTRFHFFNYICCCLIRDLIPVKRPRSFAIPREDDTAAIDAFLLQNPSYSRLVILVYVSALNINIFLRQPIQNKWGHLQDRACRIMSLFDVDSNSLYNREEDEILFTFAKLNRILETIHIKLHETEDEPLDPQDGLAPLAQINLASSLQMELQTIYSQIPPKRVRALAFYHSVEAYLHEWLFSRFMARFPDHSVIKELPAAVSESFRNFTKSCMSAMHEFLKLSPELIASLPLFHISRVIYTVGMLLIRVRYTSMTVPAFALYKELSQPAISLVRQISESLNESAALFPYNNFLSKLRYVVALFVQIYANKMKVYVKNSKSDAECLNHPAAYGASEMVPVPHQSSVPMLLNPVSPPHDSASVPEVPQNVDTSATELSSKIADELPYQLADMSSLEYGISALNDEFWTDVFLGAM

SEQ ID NO: 291 - DNA, 2430 bp, Saccharomyces kluyveri
atgtctcactggcttcaagagcacaagatgacacagcaactatattccgagggtgagacggaaagttcctctcaaccaagtaaagaaaatgcatacattattggtgtaccgccagatgaccctagactacattcccctgtatcactgagtaaaaatgatggtgggaagccaaagagaaacacttttgcttgcaccaactgtcattctctcaagcagaaatgtgttccttctgatataaataatatctacgggagaccctgtcagcgttgtatgaagtgcaacagaacttgcaaattcgacttatctaagagaactagaaagaaaaaaaggaagatgatacacgaatatgaagagaaccggttttcttcttctccatctgctgtggataacttcagtgaagaagtgaaggatccgacaatccaatcatctggcatggataacattattgaccctctatcgcgtttcgaccctgtcaagttcgctgcaacggaagcatcgaacgaaccgccgctatctgggagcatcagaggtattaaaaggctgaaaaatcaaacgagcactgcgactaaggtacgcgccaaccgtaaatctccgttgcaaaaagagttgcaagcactactttcaatgcaaaaggggaaattagattcaatttcacaaaaacttacagatttatccacaaagtggaatgagatagtggaaaataatagcttgtttggaccagtgtctgatcctgtcaccctgaagataatcactcagtcggagtctgaataccgtttacatctgtatagaacaaaaatgaatcaaaagtttaagctgccgtttgtgaacatccctagtgatattagtgcagaacaactgcgaagtagccaaccaatcttattctccgttatcatgtcggttgtttctttaattttgtccaaggatcaatctacaacaaagctcacaatgcagctagataatctggccttggggttgatcagccaccaagtaatgcgtttgggaaacaagtcaatcgaattgttgaagtccttgctaattttatgcatgtggtacaacttccctgagctctcgcacaaaactcgttaccatttcttcaactacgtttgttgttgtttgataagggatttaggccctacaaacaaaggcaaattgttcatgcctgcaggagataacacacaacaacaacaacagcagcagcagccggctaaaaagacaccattggaaaatgacgaagaccaccaacggctgattctactagtttacgtctcatctttaaacatttccattttcctacgtcaatcaacacaaatgaggtggtcttctttattggagagatcttgtagcgaattgatgagcggagattataaaagtgatgtatacggtacccaagatgatcaccttttggtgcttttcacaaaactaaaccatgtcttggaaaaagttcatatgatattacatgaggtagactcatatagcaacgacagtacttcctacaaagataggtcagagataatcatagacttacaattacaactagagagcatttttcagaaaattcctaaagaaagaaacagggtattagcatttttttactctgtggaagcttatttgcacgagtacactttctctaaatttattgacagcatcgaaaataaaagtgaactccatgacctaccagcacctgtttcagactccttttccaaatgttgtcagtcatgtaccaatgctatgaacgaattcttaaaacttacccctgaactaattgcatctctccccctctatcatatatccaggatcatctatactgtagggatgttgttactgagactgcgatatgttacaatgaccgttgcagcctttcgacatttgcaatcaatgactgcacaggcattgccacttgttaaaaaaatttccaagttattggatgaaagttttgaattatttccattcaacaatttcctctgtaaattaaggtatgtggtagcattgttcatacaaacatacgcgaacaaagtgacatacgttttagaacatgaagatgaggatctgaaaaatggatcaaacagtttgaaaaatgacatgatagcttctgcgggtagtggcccagcactttcatctaccgcgtatcaccaagacagaaaaatcaacagctataataatgaaaacatccagtcaaacgttatcggtgaaactacaacaaatataatcgccaatcctattctgcatcctctattggcttctgatcttttacaaggacagccacctatcatgtcctatcaaagtggcattccatctaatgtgagaccttcaaacaatacaacaccaagcgaggacatgaccaattacttggcggatattaattctttagagtttggttacaacgctttgaatgacgaattctggacagatgtgttcatgaatagcatgtag

SEQ ID NO: 292 - protein, 809 aa, Saccharomyces kluyveri
MSHWLQEHKMTQQLYSEGETESSSQPSKENAYIIGVPPDDPRLHSPVSLSKNDGGKPKRNTFACTNCHSLKQKCVPSDINNIYGRPCQRCMKCNRTCKFDLSKRTRKKKRKMIHEYEENRFSSSPSAVDNFSEEVKDPTIQSSGMDNIIDPLSRFDPVKFAATEASNEPPLSGSIRGIKRLKNQTSTATKVRANRKSPLQKELQALLSMQKGKLDSISQKLTDLSTKWNEIVENNSLFGPVSDPVTLKIITQSESEYRLHLYRTKMNQKFKLPFVNIPSDISAEQLRSSQPILFSVIMSVVSLILSKDQSTTKLTMQLDNLALGLISHQVMRLGNKSIELLKSLLILCMWYNFPELSHKTRYHFFNYVCCCLIRDLGPTNKGKLFMPAGDNTQQQQQQQQPAKKTPLENDEDHQRLILLVYVSSLNISIFLRQSTQMRWSSLLERSCSELMSGDYKSDVYGTQDDHLLVLFTKLNHVLEKVHMILHEVDSYSNDSTSYKDRSEIIIDLQLQLESIFQKIPKERNRVLAFFYSVEAYLHEYTFSKFIDSIENKSELHDLPAPVSDSFSKCCQSCTNAMNEFLKLTPELIASLPLYHISRIIYTVGMLLLRLRYVTMTVAAFRHLQSMTAQALPLVKKISKLLDESFELFPFNNFLCKLRYVVALFIQTYANKVTYVLEHEDEDLKNGSNSLKNDMIASAGSGPALSSTAYHQDRKINSYNNENIQSNVIGETTTNIIANPILHPLLASDLLQGQPPIMSYQSGIPSNVRPSNNTTPSEDMTNYLADINSLEFGYNALNDEFWTDVFMNSM

SEQ ID NO: 293 - DNA, 2760 bp, Kluyveromyces lactis
atggaaatggatttgaatcagagcccggattcaggtgaaggtcaaacgttgcagatgtcgctggaagagcagcagcggcaccattctcaagttgttcttcttgggattgcagcagatgattcaaggcattttaccccaatgtccaaggagacaaatgctgatgggaaggtgaaaagaagcacttttgcgtgtatcagctgtcattcgatgaagcagaaatgtaatccgacagaccccacagatatatacagacatccctgtatcagatgtgcaaagttgaacaagatatgtcagtttgatttgtccaagaggaggaggaggaagaagaaaaagaagctcgggaccgttggtgacggcaatcttagcggttatgtgggtgctatgaaaaatggtggggccagtaccacgaacggtgatggttcagcattaaatccgaaatctgatatcgttttgaagcccctcggttctaatggtaacgcagcatcagattccgtagttatggcagatgacgacgatacttctaattcgtctgcaagaactctttctccatacgtttccatctctgctccacagcagcaacagcgtgctggtctcgttggcagcgaacagacgactagcttcccgttggcctactctctcccgaataattactcaacgccgacagcaacgcctaatatcaaccttgcaccaggcttcaaaatgaaacaacctctaacgaattcaacgacatggcaatacccttctccagcaatcagtcagcatcagagattgctaccgaaaccatggttagaagctgaccttaaaaagttggagaatgcgaaacgttcgcatttacagcgttcttacgctaataatatcattaacgtacctcaaactgacccaaattcatctcacacagctgcagtattagggcaaagtgccctttctgttcccagtaacgatcccatggggaacataacatacaatactcacgctgagacaagccatctccgtcatatcaaccaagctaattcgcagcaacttaataacggtaccggtcatacgttaaaggccatttcacctaatatctcctcgaacaataattatctgctgaattctcacaacagtaaactgaacggaaatggtaactccattaatggccgtcatccttctgtagcgcctaggcctggccaagttaacgactatgaacttgaaataacgaatctactttcatggcaaaagggcagtctagagtctacagctgcaaaactaacttctctggcagttgcctgggaccaagttgtgcagactgcatcggctgtccctctctatacggaccccttagcgttaggtttgatctctgagcgagaagcactctattacctacagctttatcgtgaaacgatgtcaaagaaattccatttaccattggttaaaattccagatgatattacgatcgaccaactacgaaagactcaaccaatattgttttctaccatactttccgttgtatccttgatagtgccagcatctcataaatcatcagttaataagctaaaattagataattttgcattgtcattgatatgtcatcatggaatgagactaggaagcaagagcacagaactaatccgttccttgttggttttatgtttatggtataatttctcagaatggaataatcagaccaggtatcactacttcaattatatatgctgctctgccatcagagatttcgatttgaacggtaacaacagactaatggatatgatggactctgcgcaacagaacatggtcccagagaagaaagatcctgaatatgacgacgaattttatcggatggttttggttatatatgtgtcgggtttgaatatttccatattcttgaggcagccaattcaattgagatggtccccaaaatttgacacgttctgtgaaggactcttgaatggtcagtatccttcgaaaatatacggatttgaagatgataagctcttcgtaattttcgcgagaattaatcattgcttagaactgattcatactcatattcaattggcttctggggttatggaaaacacatatattactatcgataacgagaaatttattgaaaagatgaaagattcattggatgctatttatcccgaaattccaccagaaaaacaccgtattttggcatttttcaattcggtatatgcatatctttatgaatccattctaatagattatttccaacctaaaactatggaggataaatttgagttgcaagaattaccagcatacgtagaagatgcatttaaaaactgcttgacaaagtgcttggcaacgttcaactatttcttcaaacttactccggacttgattgcatctatgccattattccatgtaacaagaataatttatgttcttggtgtactattattaaaaattagatatggtgcgatgacaatcccagctattcaacacctaagaccattgactgattcatgcatcgatattcttaagaatatgtgtgggatattggatgagacatccagactatatcctcaaaacagtttccttgtgaaattacgctacgtatgtgcgttattttctcagacgtatgccaccaacataaggaaatatttggaaagacaaagcaggaactctgatccggagatcaacaatttattccaatctaatgatgtttcctcgttctttgtggattcgatgatgctcgaaaattctatcaattctttgaatgaccaattctggacagatatgttaacaaacttactataa

SEQ ID NO: 294 - protein, 919 aa, Kluyveromyces lactis
MEMDLNQSPDSGEGQTLQMSLEEQQRHHSQVVLLGIAADDSRHFTPMSKETNADGKVKRSTFACISCHSMKQKCNPTDPTDIYRHPCIRCAKLNKICQFDLSKRRRRKKKKKLGTVGDGNLSGYVGAMKNGGASTTNGDGSALNPKSDIVLKPLGSNGNAASDSVVMADDDDTSNSSARTLSPYVSISAPQQQQRAGLVGSEQTTSFPLAYSLPNNYSTPTATPNINLAPGFKMKQPLTNSTTWQYPSPAISQHQRLLPKPWLEADLKKLENAKRSHLQRSYANNIINVPQTDPNSSHTAAVLGQSALSVPSNDPMGNITYNTHAETSHLRHINQANSQQLNNGTGHTLKAISPNISSNNNYLLNSHNSKLNGNGNSINGRHPSVAPRPGQVNDYELEITNLLSWQKGSLESTAAKLTSLAVAWDQVVQTASAVPLYTDPLALGLISEREALYYLQLYRETMSKKFHLPLVKIPDDITIDQLRKTQPILFSTILSVVSLIVPASHKSSVNKLKLDNFALSLICHHGMRLGSKSTELIRSLLVLCLWYNFSEWNNQTRYHYFNYICCSAIRDFDLNGNNRLMDMMDSAQQNMVPEKKDPEYDDEFYRMVLVIYVSGLNISIFLRQPIQLRWSPKFDTFCEGLLNGQYPSKIYGFEDDKLFVIFARINHCLELIHTHIQLASGVMENTYITIDNEKFIEKMKDSLDAIYPEIPPEKHRILAFFNSVYAYLYESILIDYFQPKTMEDKFELQELPAYVEDAFKNCLTKCLATFNYFFKLTPDLIASMPLFHVTRIIYVLGVLLLKIRYGAMTIPAIQHLRPLTDSCIDILKNMCGILDETSRLYPQNSFLVKLRYVCALFSQTYATNIRKYLERQSRNSDPEINNLFQSNDVSSFFVDSMMLENSINSLNDQFWTDMLTNLL

SEQ ID NO: 295 - DNA, 2838 bp, Candida glabrata
atggaagaaaattgtgtgagagcggatgcatcccacacgtatgaacctggtcccaacgactatgttgttaataacaagcatctaacagtaatagtaggtgttgaacctgatgatattcggttatcacagccctcgcagttggaagtgaatgagaacggtaatatgaaacgtaacacatttgcttgtgtgaaatgccatgacttgaaacagaagtgtcgtccttccgatgttggggatatatatcgaaacccatgcgttagatgcttgagaagtcgagatccttgcatatttgatttagctaagcgaaagaggaagagagtaagacgatctcgacatgaaaatagtgttggtaataataagtaccagaagaggaaaaatagtaggaactctgaatcacagagtagtagtgataactacgaagagcctagagtacctttggctatacctaatatccagcagacacctatatcgattattgaaaatcctgagtcaatcagaaaccaaaactggcctattgttgattcaaatcagtatccaaaaacaagtatcacattgggtcagccacagtcatcaaatgacttgaacgctattatgaggacaccaaccactattagtgtatctcagagatatcctcaaaccgatataaattccttactggggagttatcctaccagaaacaatgcttatgatgaatcgacggtacctttgggatcaaacataccgttaattccaactactagcaatgatgtcgtccgtcctagcaataatactttaaaaacaccgaatgtaggtaacgttggaagtttgtttaacaatcatattgacactgctaaccctaccatattgagcccacttcaaaataatacatatgatagacaacagtacgcttactctagtaactccaacaaaggtgggtctcattttgactcggtgaagtctccaaaaaactcacatattaatcgtctgacacattcattcaaaaaacaactgcaatctcttgtgtatcatcaaaaagagaagattgagacaacatccacattattaggtcaatgggcgaaaacttggcaagatatgatcgacagatcggatttattgccagttacaggtgaccctgttagtgccggtataattactgcggaagaagctgaactccggcttgaaaggttctcaacagatataacattttttgctggactttccttcattaacacaggaaataatacgaacgtaaatataatgagaactgaaaagccaatgttattctcagttgtcatgtcatgctcgtcgatattattagctccacatgaaacaaatccagtaaccacaatgaggcttgatacatttgtattgaaacagattacatctaacatattcaagagaagagtggatgcagtgcagttggttcaatcccttctaattctatgtttgtggtataatttcttagaatggccgtcaagaaccaaataccacttttttaattacgtgtgttctattataacaaaggagttgaatcacagacctcatccaggaagggtatttgatgtctttccagagaaggagccacaacctgaatatccagtctatgtgtacagactgatattgcttgtatacataacatcgcttaatgtttgcatattcctacggcaaccgttgcatactccatataatgaatgcatagatatcgcgtggaaacaggcagcaagagactcaaagttgcaaataactgaggatcataaagaagatgctcatgttttggtagtttttacatcattatgtcgagtattagagaacattcacgtgaaacttcatgaattggaaaagaatgacgaattccttttatatgatacatctaaaatgatacagagatatcacacgcaattagatgagctatatacagagattccattaaatcgtgatagagttgtggcgtttttctattcaattaaagcatatttgtatcaatacacattggaagacttcataaagaagaatgttaatagtttgaaaaagggtgatccagtgccagatgatataactgcagccttcaagagctgctataattgttgtgttcagtgtctagagaatttcatgaagcttgacagtaaattaattgcatcacttccgctttttcactcatctaggatggtttacattgttggcctcattcttttaaagttaaggttcaaagtagtgacctctgcagctttccaccatctattgcatgatacagataaagcggtagcattggttagaagagtggcggatgcactggaaaaggcatctaaattatttccatataattatcccttatacaaactacaatacgttgtggcactattttgtcaaacatatgctaagagggttattgaagcatcggaatcaagcacagtaaaggcaaagagtaatccccatacacaatttaatacacaactattgagaaatgaatatgctagtgttactaaaactcctgttaccgatacagaaaatactgtttcagcagatgtattgccattccctgctgattcagcgcctacccaaggtaagctcaccaggaactctaccgatgatagtaatacacctattaacaatgatattagcagcggaattgtggggtataaaacagaaaaagaagatttaaatggaacgaataataatccgaataatggcctgttaaatccacaggtcaaagtgaatttggagagtcaaaccttaaattcatctccgtcttcatctcttaataatttcaatgattatttaactgacatgaattcattactgtggggtgtgaatacacttaatgatgaattttggtctgatctctttctccctggaatttga

SEQ ID NO: 296 - protein, 945 aa, Candida glabrata
MEENCVRADASHTYEPGPNDYVVNNKHLTVIVGVEPDDIRLSQPSQLEVNENGNMKRNTFACVKCHDLKQKCRPSDVGDIYRNPCVRCLRSRDPCIFDLAKRKRKRVRRSRHENSVGNNKYQKRKNSRNSESQSSSDNYEEPRVPLAIPNIQQTPISIIENPESIRNQNWPIVDSNQYPKTSITLGQPQSSNDLNAIMRTPTTISVSQRYPQTDINSLLGSYPTRNNAYDESTVPLGSNIPLIPTTSNDVVRPSNNTLKTPNVGNVGSLFNNHIDTANPTILSPLQNNTYDRQQYAYSSNSNKGGSHFDSVKSPKNSHINRLTHSFKKQLQSLVYHQKEKIETTSTLLGQWAKTWQDMIDRSDLLPVTGDPVSAGIITAEEAELRLERFSTDITFFAGLSFINTGNNTNVNIMRTEKPMLFSVVMSCSSILLAPHETNPVTTMRLDTFVLKQITSNIFKRRVDAVQLVQSLLILCLWYNFLEWPSRTKYHFFNYVCSIITKELNHRPHPGRVFDVFPEKEPQPEYPVYVYRLILLVYITSLNVCIFLRQPLHTPYNECIDIAWKQAARDSKLQITEDHKEDAHVLVVFTSLCRVLENIHVKLHELEKNDEFLLYDTSKMIQRYHTQLDELYTEIPLNRDRVVAFFYSIKAYLYQYTLEDFIKKNVNSLKKGDPVPDDITAAFKSCYNCCVQCLENFMKLDSKLIASLPLFHSSRMVYIVGLILLKLRFKVVTSAAFHHLLHDTDKAVALVRRVADALEKASKLFPYNYPLYKLQYVVALFCQTYAKRVIEASESSTVKAKSNPHTQFNTQLLRNEYASVTKTPVTDTENTVSADVLPFPADSAPTQGKLTRNSTDDSNTPINNDISSGIVGYKTEKEDLNGTNNNPNNGLLNPQVKVNLESQTLNSSPSSSLNNFNDYLTDMNSLLWGVNTLNDEFWSDLFLPGI

SEQ ID NO: 297 - DNA, 2571 bp, Kluyveromyces polyspora
atgaattctgaacaaaatgtttcagcgagattaaatgaatactatgggtcatccgatagaaatatgaacaatgatgataattcgagaaactataatataacagtgattacaggtgttaatagtgatgatcctaggttatcagtaccgactaggattaatagtagcgaatgggagaaaaggaagagaaatacttttgcctgtataagttgccatgcttctaagcaaaaatgtgtaccatctgatttagatgatatattcttaaagccatgtcaaagatgttttagaagtaaaaagatatgtgcatttgatttgtccaagagaactagaaagagaaagagtcgatctataggcccattgaaacattctgcatcttctgaagaagtaagtaatcaagtcaaaattagtagccaaagcatgcagcattcaattactttacaagatcagtctctaatgaaacaaaatctggcaaatataccatattcaaaccagaatgttgctttgtcatgttctggtttagaaaatcagccttctgctgatcaatcttcgatcaaaacaactgataaaaatatcttaccagggatccaacaaagcttatatgatttgtggccaacaataaacaagaatagattaaataattccaataaattagagactccaatttctaatgcacctgtactgtttccatctaatggctatgaggggaatgctggttcttcggtgccaagttataatgaggtgtcagaggacaaatcaaataagagaaaatatagaggctcatatatatacaactcttcatttagaaaacaacttcgttcactattggaacagcaaaagggtaaaattgttgaattgtttgaaaaattcaatagattatctgaaaaatggaatgctactgtcctaaatacttattttacagacacattgactgatcctgtctctattggaattatatcgcacagagaggcagaattacgacttcaactttataggacagaaatgactgatagaaataaattaccattcgtcaaaagtttttctgaaatatctgtcgatactcttagaacagaaaaacctatttacttttctgcaatcatgtcaagtgtatctgtaatgatggcagaaaaggatacaacttacgagaccaatttaaaattggatagctttatgctgcatatcatcaagaatcagttattcaagagcaatgttaaatcgatagagcttttagaagggttgttaactttatgtttatggtataacattccagaatggtcaagcaaaacacattatcatatttttaattatatctgttgttgtttgactagagacttaggacccacatttgttgcacgtacttttgaaatttttaatgaagatgaccctttccataataaagatcaatacaaaactcccttagaaacttacaaaaatggaccaaggcttactttggtaaattacatctcatccttaaacatatctttatttttaagacagagtaaccagataagatggtcatcattaactgaacatgcttgtaaatctgttctagaagaaaaagagaagaatttaatgccaaaaattgaagacgatgacagaatgctgatagtattcgcaagattaaatcatttattagaaaagatacatttgcaattatatgaagcctccgattatcacgaagaggatgatgatcctgaatttacagataaacatatcagaaaactgattacaaagtatgaacttcaactaaatagcatcaaagaagaaataccagctactcgccatagagtgcttgcattctattactctgttgaagcatatttccatcaatttattttaaggaagttcttaaatgaatcacctaatccaacagaattgacagaggaagttagaattgcatttatcagatgtaataaatgttgtatggccacattacaagaatttgcaaaattagaacctcagttcatcgcgtcgttaccattatttcacatttcaagaataatatataccgttggtttacttttgttgaaggtcagattttgcagtgtgacaatgcctgtattccatgaatttttagctgacaccgatccatcagtagatgttgtgaatgaaatttctaagttacttgaaagaactgcagaaaaatacgtatacaatactttcatattaaaattccaatatgttattgcattatttgtacaaacatatggtaataaagtgatagattcagcaaagagttcctcaagaagacaatcaacaaataatgaacacgagattatcaataaagagaatatacgagaatatccactggatatacagaatagtgatacactaattaacaattatgataattcacaaaaagaagtcgtccctactcaaaatcagaatacttctagcaatatattcccttctgtaaaacctgagtttgaaaatgaggtgctcttaccaacagaaacatcttcatcaccatctacatcaagcataaatctaaatgagtatctagctgatatagactcattggtacttggtttcaatgctttgaacgatgaattttggactgatgtatttaacatttaa

SEQ ID NO: 298 - protein, 856 aa, Kluyveromyces polyspora
MNSEQNVSARLNEYYGSSDRNMNNDDNSRNYNITVITGVNSDDPRLSVPTRINSSEWEKRKRNTFACISCHASKQKCVPSDLDDIFLKPCQRCFRSKKICAFDLSKRTRKRKSRSIGPLKHSASSEEVSNQVKISSQSMQHSITLQDQSLMKQNLANIPYSNQNVALSCSGLENQPSADQSSIKTTDKNILPGIQQSLYDLWPTINKNRLNNSNKLETPISNAPVLFPSNGYEGNAGSSVPSYNEVSEDKSNKRKYRGSYIYNSSFRKQLRSLLEQQKGKIVELFEKFNRLSEKWNATVLNTYFTDTLTDPVSIGIISHREAELRLQLYRTEMTDRNKLPFVKSFSEISVDTLRTEKPIYFSAIMSSVSVMMAEKDTTYETNLKLDSFMLHIIKNQLFKSNVKSIELLEGLLTLCLWYNIPEWSSKTHYHIFNYICCCLTRDLGPTFVARTFEIFNEDDPFHNKDQYKTPLETYKNGPRLTLVNYISSLNISLFLRQSNQIRWSSLTEHACKSVLEEKEKNLMPKIEDDDRMLIVFARLNHLLEKIHLQLYEASDYHEEDDDPEFTDKHIRKLITKYELQLNSIKEEIPATRHRVLAFYYSVEAYFHQFILRKFLNESPNPTELTEEVRIAFIRCNKCCMATLQEFAKLEPQFIASLPLFHISRIIYTVGLLLLKVRFCSVTMPVFHEFLADTDPSVDVVNEISKLLERTAEKYVYNTFILKFQYVIALFVQTYGNKVIDSAKSSSRRQSTNNEHEIINKENIREYPLDIQNSDTLINNYDNSQKEVVPTQNQNTSSNIFPSVKPEFENEVLLPTETSSSPSTSSINLNEYLADIDSLVLGFNALNDEFWTDVFNI

SEQ ID NO: 299 - DNA, 2436 bp, Kluyveromyces thermotolerans
atgtccgggtatgacatcgcgcaggtgacacacaagggcgaggaccgtggtggagcgagcagcgaggcgggcggcgagacgggcagtgaagcgggcagcgaggaggccagcaggaacggcagcgcgggcggcagtggcagtggcagtggcagtggcagtggcagtggcagtagtagcagtgtcgtggtcagcaggagaggcagcggtgcgacgggcgaactgtcgcgcgcggtgatagtgggcattcccctgggcgacccgcgtctgacccagcccaccgcgctggaggccgcgcccacgggcgcgggcaaacccaagcgcaataccttcgcgtgcaccaactgccactcacaaaagtcgaagtgcgtgccctcggacgtcagcgacatctaccgcaagccctgcgtgcgctgccacaagcggcgcaagctgtgcaagttcgacctctcgcgcaggacaaggcgccgccgccgcgagagcgacacttctgtcgaggcgcagggctcgcgtgatagcccgcaatacctcgcgccaaccgcggaccgtcccgtggcggagcctgaggccgcgcattcggcactgcccctaccgccgttgtcgatggcacgggtggcagcaccggcgcccaaggcgccgactcaaacagaggccgctgcccagggtgagagcgagtccaagcgccgccatttccgtagctcgttgcagcgcgagctccagctcttgcttgcctcgcaacgcgaaaacctaaacgcagttaccgataggttaacacagctctctgacaaatggaacgacgttatcgagaacagcgtcggcgtcccgctagcgttggacccagtcactctaggtatcatcaccagagagcaggcgcagctcaggcttgacctgtatcgctcggacatctcgaacaagttccggctcccatttgtcaagatacctgccgatctagaactcgacgaattccgcgaaaaggaacctattcttttcgtgacggtaatggccactgtctcgcttatgctgaagcgcgaccagtccaacgacgaccaaaacatgaaattggataacttcgcacttggcttgatatcgcaccacatgatgcggctaggcgataagtcttttgagctactgaagtcgcttctgaccctctgtctgtggtacaatttccccgagtggtcaaatcggactcggttccacttcttcaactacatttgttgctgcctaatccgggaccttattcctgtcaaaagaccaaggctattctcgatgatgaataacaaggccttacctgcagaagacgagtctgctacgattgaacagtttttgtttcagaacgaaagcttcgcccggctggtcattctggtctacgtttctgcattaaacatcaacattttcttgcggcagcctgtccaaaacagatggggatcactgcaagatacagcatcacgcatcattttactttttgagtcgggtcctcgctccctttaccagcgtgaagaggacgaaattcttctgacttttgcaaagctcaatcgcattctggagactgtccatataaagctacacgaagctgaagacgagcatttgtattgccaagaggggccgataccgagcgcgcagctcaacctaatagccaaacttcaggttgatctgcagattgtttacaacgaaataccctctggtagagcacgcgccctggcctttttccactcggtcgaggcttatctgcacgagtggttgttttcaagatttatggctaggtttccagaccattcagtcattagagacctaccctcggaagtctcagaatcttttaacaagttcgcgcaatcctgcataagcgcaatgcacgaatttttgaagctcacgcctgagctcattgcatctctgcctctttttcacatttccagggtagtttacacggttggaatgcttctgctgagagtcagatacactactatgacggtgcctgctttcaattttttgaagcaatcaacgcagtctgccgttcctcttgtgaagcaaatttctcacttgctgaatgacagtgctgcattgttcccctacaacaactttctttccaagcttcgatatgtcgtggctctatttgttcaaatctacgcgaacaaattaaaggcattctttgaggacccgaaaacttaccctgagaacgcatgccgcgttccagttaccagcatactaacgccaactccaccacaaaattccgtgccaatgttactgaacccagtttcgcctccaggctctcgcagcccagtaagcggaacacccgcaccggaggccagacagcctggttcggaggtatcgaacaaacttatcgatgacctttcattccaattggctgatttgagttccttggaatatggcttcaacgcgctcaatgacgaattttggacagatgttttctttggcgccatgtaa

SEQ ID NO: 300 - protein, 811 aa, Kluyveromyces thermotolerans
MSGYDIAQVTHKGEDRGGASSEAGGETGSEAGSEEASRNGSAGGSGSGSGSGSGSGSSSSVVVSRRGSGATGELSRAVIVGIPLGDPRLTQPTALEAAPTGAGKPKRNTFACTNCHSQKSKCVPSDVSDIYRKPCVRCHKRRKLCKFDLSRRTRRRRRESDTSVEAQGSRDSPQYLAPTADRPVAEPEAAHSALPLPPLSMARVAAPAPKAPTQTEAAAQGESESKRRHFRSSLQRELQLLLASQRENLNAVTDRLTQLSDKWNDVIENSVGVPLALDPVTLGIITREQAQLRLDLYRSDISNKFRLPFVKIPADLELDEFREKEPILFVTVMATVSLMLKRDQSNDDQNMKLDNFALGLISHHMMRLGDKSFELLKSLLTLCLWYNFPEWSNRTRFHFFNYICCCLIRDLIPVKRPRLFSMMNNKALPAEDESATIEQFLFQNESFARLVILVYVSALNINIFLRQPVQNRWGSLQDTASRIILLFESGPRSLYQREEDEILLTFAKLNRILETVHIKLHEAEDEHLYCQEGPIPSAQLNLIAKLQVDLQIVYNEIPSGRARALAFFHSVEAYLHEWLFSRFMARFPDHSVIRDLPSEVSESFNKFAQSCISAMHEFLKLTPELIASLPLFHISRVVYTVGMLLLRVRYTTMTVPAFNFLKQSTQSAVPLVKQISHLLNDSAALFPYNNFLSKLRYVVALFVQIYANKLKAFFEDPKTYPENACRVPVTSILTPTPPQNSVPMLLNPVSPPGSRSPVSGTPAPEARQPGSEVSNKLIDDLSFQLADLSSLEYGFNALNDEFWTDVFFGAM

SEQ ID NO: 301 - DNA, 2247 bp, Ashbya gossypii
atggactacagcgtggccaagacgatcatcgtggggatcccagcggatgacccgcggcaccacacgccgatctcgcaggagatcgggagcaacgggaagccaaagcgcaacacgttcgcgtgcacgagctgccacgcggtgaaacagcggtgcatcccgacagacatgggcgacatctaccgcaagccgtgctcgcggtgcgtgaagctgcgcaagccgtgcgagttcgacctgtcgaagcggacgcggcgcaagcggcgcgcggcgggcgcgcggccgcggcggcgcgcggggcgggcgcgcgagcgcgcggcggtgcggtgggcggggcgtggggcgccgctgtcgccggcgagcgggctggcggcaccgccgccgcttgagggcggcgcggaggcggacgggctgacggaggcggaggaggaggaggacgcgcaggcgcagctggcgcgggagctggcgcgcgtggacgggagcgcgcggcggctggaggcgctggcggagatgctggccgcggagtcgcgcggctggggggcgtttctggagggcagcgcggcggtaccgacgctgagcgacccggtgtcgctgggcattgtgacgctggcggaggcggagtaccggctggactgctaccgcgaggtcgtcgcgggcggcatgcgcctgccgttcctgcgcgtgccgaagagctgcacggcggaacagctgcgagtcgagcagccgatcctgtttgcgacggtgctgtcgatggcgtcgctggtgctgccgggcgcggcgggccaggaggtggtcaacatgaagctggataacttcgtgctgacgctggtcacccactactgtatgcgcatcggcgaccgcacggtcgagctgctcaagtcgctgatcctgctctgcatgtggtgcaactaccccgagtggtcgcacaagacgcgctaccactacttcaactacctgtgctgcaacctggtgcgcgacctgggcatgccctacgcgtaccggcccatcctggtgggcgaggacgagggccagcagcggaagctgtccgcgatgttggagcaggacccggagtacccgcgcctgatcctgctggcgtacattatctcgctcaacatgtcggtgtttctgcagcagccgatccagttccactggtcgcctgtcgtggaaaaggcatgcagcgacatcctcgacgcgcggtacgtctccgagctctactccgcggaggacaatcagatgctgatgctgttcgcgaaactgcacctctgcatggagcgtgcctactcgatgcagcgcgtgaactccggctactcgttcgttgccgccgacaacgacgacacattctgctccctgttcagggagcttgagggcatcaagatgcagatgccaaagcactactgcactggctatattctgactgtcgaggcgtacgtgtacgagtcggcagtctcttgctatctgctaagaaacggggcgctgaactacccactgccggacaacatctccgacgccttcctgaccgcgacagagcgctcggtggccgcaatgaaggacctgctcagctcaggaaatgacatcatcccctcgatccagttgctcggcgcgtcccggatcatctacacgatgggtatgtccttgctcaagcttcgctacaacgccctgaccatgccggccttcgagccgctcagatcctctaccgaggagatattgccgctcttgcaacgtattgctacattcctcgatcagctacacgagagctacccttacaaccgatcgattagcaagctacagtatgtgtccgcattgttcctccacacgtaccaccaaaagatcaaaaaatgcatatataggcaggagaccacgacattcccaaccctctgtatgccagtaacgcctacccttgacaggagctcaccatcctcggcgcaattgttaagtgagtccttgggctttgctaatattcctaccggaacgaataatgacattcaggcgggcttgcttagggcgcctagcagcataattgagcctgatgaaaagaaattccataccatcaaggtcaattcaatatacaagcacatcgctggtacgccttctgcggagttcagcggcggccagctcttctgcgagcctagctctgcgccgcactctgttgactatctgtctgactacctgatggacaacgcttttgtagagagcgactatgatgccttcaatgatgaggtgtatggtaccgcattcttcccacagctaaaatga

SEQ ID NO: 302 - protein, 748 aa, Ashbya gossypii
MDYSVAKTIIVGIPADDPRHHTPISQEIGSNGKPKRNTFACTSCHAVKQRCIPTDMGDIYRKPCSRCVKLRKPCEFDLSKRTRRKRRAAGARPRRRAGRARERAAVRWAGRGAPLSPASGLAAPPPLEGGAEADGLTEAEEEEDAQAQLARELARVDGSARRLEALAEMLAAESRGWGAFLEGSAAVPTLSDPVSLGIVTLAEAEYRLDCYREVVAGGMRLPFLRVPKSCTAEQLRVEQPILFATVLSMASLVLPGAAGQEVVNMKLDNFVLTLVTHYCMRIGDRTVELLKSLILLCMWCNYPEWSHKTRYHYFNYLCCNLVRDLGMPYAYRPILVGEDEGQQRKLSAMLEQDPEYPRLILLAYIISLNMSVFLQQPIQFHWSPVVEKACSDILDARYVSELYSAEDNQMLMLFAKLHLCMERAYSMQRVNSGYSFVAADNDDTFCSLFRELEGIKMQMPKHYCTGYILTVEAYVYESAVSCYLLRNGALNYPLPDNISDAFLTATERSVAAMKDLLSSGNDIIPSIQLLGASRIIYTMGMSLLKLRYNALTMPAFEPLRSSTEEILPLLQRIATFLDQLHESYPYNRSISKLQYVSALFLHTYHQKIKKCIYRQETTTFPTLCMPVTPTLDRSSPSSAQLLSESLGFANIPTGTNNDIQAGLLRAPSSIIEPDEKKFHTIKVNSIYKHIAGTPSAEFSGGQLFCEPSSAPHSVDYLSDYLMDNAFVESDYDAFNDEVYGTAFFPQLK

SEQ ID NO: 303 - DNA, 3108 bp, Zygosaccharomyces rouxii
atgagttcaggtggcgaaggaggtttgtctggcacgcttcttcccgcatttagtggtagtagtagtggtattggtagtgatattggtaatagtaacaagaataataataatactggtggaatgcagagcagggatagtgacagctctgcaattaatgtaaatgaggaaggtgtaatagttggggataatgaacaaccaggtcgcgtcaatgttcgtgcctgcacattgattaagggtgctgcagcgcacgatccaagaattatagaaccaactcaaatggagacaagcgaaggcggtaaattgaaaaggaattcatttgcatgcataagctgtcactcactaaagcaaaaatgtgttccgtctgattttaatgatatttacagaaaaccttgcatacgttgtttaaaaaatggtaaattgtgcagattcgatttgtcaaagagaactagaaagagaaagcgccgtggttctcctctttcttcaccttcaagtacttcaccaaaattagatcttcgtaatggacatgatgttggcggtgggttcagaaaggaatatccaatatctgttagtaataataacaattccatacaccgtcgtccctactctcatgatattttacaaaatgatcaacatccaatctctgaaacgtggtccagtcagtcccatacaccgacaccaatagacacaccaaccggttttaatgccccatccacatcagctactgcggccgctgcatcaatggctgctgcctcagctgcaagtgcgtacccaggtggatatcaaggtgggttttcaagtggaattccaagcggatatcccgctggttatacaagcggatatcccagtgggtttgccggcggagtccccattatgttaaatgcaaatggagctccggcggtatcgatgcctagtgtcctacttggtaatcatcagttgggggaaatgccaggaaatatggcttcaacaatttcaatgcaggaccctacttcagtaaacaacactgacggtgacaacggtggtgctcgcgacttaaattctagtaccggcggctcttctactgtcggtaatgtagtgacagcaaacagtggtaatatcaccaacaataacgataaaaactctactgatggaagtggtagtggattacttccaaatcgaaggggtatagatgagaaaagtggggttgcgaaagaagaaccagcatcgtctcttaaaagaaggaattctctctttaagggccaattacacgacctgttaaccaatcaaaaggacaaaataggccagatatcttcatcgctaaactctttgagtaaacaatgggataccttaatacagagtactatgtcgatcacttcgtcttcagatcctgtatcactaggtgtaatcctcccggatgaggctgaagttcgtcttcaaattttcttgcatgatgtggtacccaaagttaacttaccctttatcagcctttcagcagatataaatgcagatcaattgagacgtaataagcctatacttttctctaccataatgtcatgtgtgtctggtatgatgacgcaagagaattcaaataaggagaccaatatgaaattggattctttcctattggacctaataacagatcaaatcttcaaggcgaataacaaatccattgaattaatcgaatctttactaacgctatgcttttggtacaattttccagaatgggcccataaggcgaggtatcatatttttaattacgtatgcgtctgtttggctaaagaaatgggccctacatttatgcaccgtgccttcggtatgttccttgaagaagatcctagttccacacaacatccaataacggcaccattagatcaatacgaagatggtgcgcgcttgatcctattggtttatatctcttcattgaatatttccattttcctaagacaatctatcaaggcgcgttggtcgcccaccatagaacaagcatgctcaaatatttgtaaaaggatgttaggtgaaaacaatgcttttaatgatgatgataaaactttggtggtttttgcccggttaaaccatatattggagagaattcatatcaatcttcatgaacacagtgcagtggatctaccttatagtaaggagtgcgaacctactcagacacatcttgatcatctgatatcaaaattcaagtacgacctaagtgagctattcaaagaaattcctgaagatcgtcacagagtgatagcttatttctattcagtggaagcatacctataccaatacatcattgacagttatattgaaaagatgccaactaaatttggtatagggccattgcctgcaaatattagtgatgcgttcttaagatgctatgatttttgtgctcgaacgttaggagaattcgttaaactaacacccaagctcgtagcttcgttaccattgttccattcatcccgaataatatacaccgtgggtatgcttcttttaaaattaagatattcagctatggcgctacctgcattccaacagtttcaacactctactgaagatgctgtttttcttgtgacggaagtttccaaattgttagaagagagctcaaatattttcatctttaataatttcctctacaaattgcggtatgtggtggctcttttcgtacaaacctacggtaataaggtgaaggcattggttaattctagcgatattagacgatcatctaccactaacgagatcaaatctgatgaaacttcacgtactttcacgacaggttcaacagaggtaccaacaaaagcaacaacaaatacaaaaactacgacagggatcatggagccgcccagtaatctacctgatccaaataatgttatattaaacaccgcatatccggctattactaacacagacatgatttcgccgtcccagacctctaacaatcaagagtttgataaccgtatggggcttccaacaacgtcttcccacgataaggttagctcaaattctcctgatatacaaccaccatctgctacttcaagtggaaacattaatgactatttaacggatgtcgattcaataatattggggttcaatgcattgaacgacgaattttggacagatattttctcaaacgacctttaa

SEQ ID NO: 304 - protein, 1035 aa, Zygosaccharomyces rouxii
MSSGGEGGLSGTLLPAFSGSSSGIGSDIGNSNKNNNNTGGMQSRDSDSSAINVNEEGVIVGDNEQPGRVNVRACTLIKGAAAHDPRIIEPTQMETSEGGKLKRNSFACISCHSLKQKCVPSDFNDIYRKPCIRCLKNGKLCRFDLSKRTRKRKRRGSPLSSPSSTSPKLDLRNGHDVGGGFRKEYPISVSNNNNSIHRRPYSHDILQNDQHPISETWSSQSHTPTPIDTPTGFNAPSTSATAAAASMAAASAASAYPGGYQGGFSSGIPSGYPAGYTSGYPSGFAGGVPIMLNANGAPAVSMPSVLLGNHQLGEMPGNMASTISMQDPTSVNNTDGDNGGARDLNSSTGGSSTVGNVVTANSGNITNNNDKNSTDGSGSGLLPNRRGIDEKSGVAKEEPASSLKRRNSLFKGQLHDLLTNQKDKIGQISSSLNSLSKQWDTLIQSTMSITSSSDPVSLGVILPDEAEVRLQIFLHDVVPKVNLPFISLSADINADQLRRNKPILFSTIMSCVSGMMTQENSNKETNMKLDSFLLDLITDQIFKANNKSIELIESLLTLCFWYNFPEWAHKARYHIFNYVCVCLAKEMGPTFMHRAFGMFLEEDPSSTQHPITAPLDQYEDGARLILLVYISSLNISIFLRQSIKARWSPTIEQACSNICKRMLGENNAFNDDDKTLVVFARLNHILERIHINLHEHSAVDLPYSKECEPTQTHLDHLISKFKYDLSELFKEIPEDRHRVIAYFYSVEAYLYQYIIDSYIEKMPTKFGIGPLPANISDAFLRCYDFCARTLGEFVKLTPKLVASLPLFHSSRIIYTVGMLLLKLRYSAMALPAFQQFQHSTEDAVFLVTEVSKLLEESSNIFIFNNFLYKLRYVVALFVQTYGNKVKALVNSSDIRRSSTTNEIKSDETSRTFTTGSTEVPTKATTNTKTTTGIMEPPSNLPDPNNVILNTAYPAITNTDMISPSQTSNNQEFDNRMGLPTTSSHDKVSSNSPDIQPPSATSSGNINDYLTDVDSIILGFNALNDEFWTDIFSNDL

SEQ ID NO: 305 - DNA, 2685 bp, Saccharomyces castelli
atgaatggaaccatcgctgatccaatgggtatcaaagatagccatttgaatggaaactctgctaattttaatgaccccaatgttaccatcattgaaggtgtcgaaccaaacgatgtaaggaggttatacccgacaaaaatggaggttaacgaagtgggtaagctaaaaagaaacacttttgcttgtgttcgatgtcattcattgaagcaaaaatgcgttccatcagatgtcaacgatatatacttaaaaccatgccagagatgctcaagaaacaagcaagtttgcaaatttgacctttctaaaagaacaagaaagagaaaacctaaaaactcagcgacgccttcacggtctcctacaccattgtcaggcttaaagagagagccttctatgggtgagcaatcaactaagctacagaagacgccaagtcctgtaaaacctactttaatgactaaccaaacagtgctcccagggatccaccaaagcttatcagacctatggggaaatataggccaacctacctcaaattctgaaccacactcatacaatactaatagcatgaacacaggactcccctctgaggtcaatatagaaaatcccagttccatcaactctaatattctaatgaacgaagcattaagagaaggagctttacaaacattaaataatgttcctatcatctacagtactgatacatcacctgccaacgttcctaacttcccggtgactggattagattcagtataccgaccatcagcaaaaagatctaaacattcgaacacacacatgagccacgaattcaagaagaaacttcaatcattattagtttatcaaaaaggaaagatctttgagctatcaactaaattcactacatggtctaatgaatggaataagatggctgaaaatagtatgtttttacccatagtctcagatccagtctctgtggggattctttcaaaggaagaggctgaactacgtttgaatctttacaagagcgaaatatctgaacaatgtagactaccgttccttaagattgctgatgagaccactgtggatcaactacgttcggcgaagccggttttattttctgttataatgtctagcgtttcagtggtaatgtcgccgtcacaaacaacaagagaaactatgatgaaactggatacatttgtattaagtctcgtaagcaatcaaatattcaaagctaataataaaactgtagaagttattgaggcgttattaacattatgcctgtggtataacttcctagaatggtccagcaagacaaggtatcatctcttcaattatatttgttgttgtttgacgaaggatctaggtccaacctttgtcaatagatcatttgctatgtttagtgacgaagatccttgtaaaactaaggctaactttaaaagtccacttgaattaagtaaagatggcgcaaggttaactatttgggtttatgtttcgtctttgaatatatcgatcttcctgagacaatcaatacagtcaaggtaccatgaagtgaccgaaaaggcctgcagagatatagtagaagtacaatctcaagaggatggattgtatgacccaatggaggatgtaatgttagtgttgttttgcaaacagaatcatatactggaaaatattcatgtctatttacatgaaaaggatgaacctcttggattagaagatgatgtagaatatagagataaccatattaggaaattgatcgataaattccaagagcaactaaacggactttttaaagaaataccagctgatcgtcacagagtgctttctttccattactctgtcgaagcgtacctccaccaatacaaagtggcaagatattttgctaaactcaatgagggagaaacgaagacagaaactttaccagaggagatcgtcgaagcatttacccaatgttattcctgttgcacaaattctctaaaggaatttttgaagttgccacccaaatatattgcatcactaccattgtttcatatgtcaagaattatatacacagttggtttgttattattgaagttacgttactctgttgttgctattccttcgttccatcccttaatacccataactgaagatgcaggtcctttagtaacaaaagttacccgtgttctagaagagtgctctgaattattcccgttcaataatttcttatacaaaatccaatatgtggtggccctattttctcaaacatatgcgaacaaagtaaaagaagtagctgagcgtcacgaagctaatgacagttcgaattctagaaagcaatttaattcacagttgctaagggaaccaattaacgcttccaaaatgactgatcctaaattgaatcctattactaatctacggattccaataggaagtgatgtaaataattctatccttaatgttcctggggcagcaatgtctgaaaatgacaccaatgaacaaataaactccgcattcactaatgccaacgtcaattctaataataatgcaaacctaagtaatactttaacaccacctttgttccaaccctatgacaagaacctctcattggtttcaggaatgaaaaattctcccacagcatctagcgataatctaaacgaatacttgacagatatgaattcattagcgtgggggtttaacgcacttaatgatgaattttggacagatctttttctcgatgagtaa

SEQ ID NO: 306 - protein, 894 aa, Saccharomyces castelli
MNGTIADPMGIKDSHLNGNSANFNDPNVTIIEGVEPNDVRRLYPTKMEVNEVGKLKRNTFACVRCHSLKQKCVPSDVNDIYLKPCQRCSRNKQVCKFDLSKRTRKRKPKNSATPSRSPTPLSGLKREPSMGEQSTKLQKTPSPVKPTLMTNQTVLPGIHQSLSDLWGNIGQPTSNSEPHSYNTNSMNTGLPSEVNIENPSSINSNILMNEALREGALQTLNNVPIIYSTDTSPANVPNFPVTGLDSVYRPSAKRSKHSNTHMSHEFKKKLQSLLVYQKGKIFELSTKFTTWSNEWNKMAENSMFLPIVSDPVSVGILSKEEAELRLNLYKSEISEQCRLPFLKIADETTVDQLRSAKPVLFSVIMSSVSVVMSPSQTTRETMMKLDTFVLSLVSNQIFKANNKTVEVIEALLTLCLWYNFLEWSSKTRYHLFNYICCCLTKDLGPTFVNRSFAMFSDEDPCKTKANFKSPLELSKDGARLTIWVYVSSLNISIFLRQSIQSRYHEVTEKACRDIVEVQSQEDGLYDPMEDVMLVLFCKQNHILENIHVYLHEKDEPLGLEDDVEYRDNHIRKLIDKFQEQLNGLFKEIPADRHRVLSFHYSVEAYLHQYKVARYFAKLNEGETKTETLPEEIVEAFTQCYSCCTNSLKEFLKLPPKYIASLPLFHMSRIIYTVGLLLLKLRYSVVAIPSFHPLIPITEDAGPLVTKVTRVLEECSELFPFNNFLYKIQYVVALFSQTYANKVKEVAERHEANDSSNSRKQFNSQLLREPINASKMTDPKLNPITNLRIPIGSDVNNSILNVPGAAMSENDTNEQINSAFTNANVNSNNNANLSNTLTPPLFQPYDKNLSLVSGMKNSPTASSDNLNEYLTDMNSLAWGFNALNDEFWTDLFLDE

SEQ ID NO: 307 - DNA, 2898 bp, Saccharomyces bayanus
atgtatagcagctttaatagccgagatcgggaaggctttcagaaggagagctgtaacatgaacacacaattttcagtagccggacttgccactggaaaggaaagtaatggcaccttgaaggcgaacagtaaaatggcctcgccaagggccgatgacccactcatagatatgactacacagaccattatagaggggtgtgttgacgacgatactagacttttgtatcctaccaaactagagactactgaaaatggtaagatcaaaagaaattcatttgcgtgcgtatgttgccattctttaaagcaaaaatgtgtaccttccgacgctaatgatatctataggaaaccatgccaaagatgtctaaaacataagaaggtttgcaaattcgaccttgcaaagaggactaggaagagaaaacaaagatcgagatcctctacatccctcgaatcgccgatacaagatgtctctaaaaaaggtgaatttcccgttaatttcaaggaatcgagcttgaagaataacacatcctatcccatcactttccctctcgactcgaatacgaaacaggtttcgaactctcgaacagttttacctggacttcaacaaagtttgtctgatctctggtcaacgttaagccagccgacttcagaaagagtaagagacgccgaatcaacacctagtgaggacagaattgtcaataaatctacgcaatctaagggcggaaactctatatcggcaaacatatccttattagcatccactgatgagcgtacgaagagcagcggtgctccggtaatatacagctcttataactcgcccataccgatgccttctatacccaccagtaccaatagcgaagcatctttcaagcctagaccaaatgttgtgggagatgagggaacttacaatggtaaagcgaaaagacaaaaaaattcatattccaaacacatgacacggtcattcaggaagcagctacaatcactaattatatctcagaaaggtaagattagagacatttcgatgaagttagatacgtggtcgaaacaatggaacgatctcgttgaaaggagcatgtttttaccgacaatatcggatcctgtgtccgtaggaatcatatctcatgaagaagccaccttaaggcttcatctttacaagacagaaatctcatatttgtcaaagttaccgtttataaaagtcgaggaaaacgtcagcgtcgatgagctaagaaagaggaaaccgattttattttctgtcatcatgtcttgtgtttccatcgtattaactcccagacaaacaaccagaggaacgataatgaagcttgatagctttgtattgaatctaattacaaatcagattttcaaggccaacaataaatccattgaaataatcgaatcactatctacattgtgtctatggtacaatttctttgaatggtcaagcaaaacaaggtaccatatattcaattacatctgctgctgtttaacaagagatttgggacccacttatgtcaatagatcctttggtatgtttagtgatgaagatcctgatagattcaaatcacctttggaactttacagcagcggttccagtttaatattattggtgtatgtttctgctctaaacatttcgatttttctacgtcagtcgatacaggctcgttggagtcacgtcactgaaaaggcgtgccaggatttgatcaaagaaaaaagaggatcacaacagaataataatgatcagctattacctggtatgactgatgatcctatcctagtacaatttgctaagatgaaccatgtcctagaaaatatccacactcacttacacgaaagagacttcaatgacgatgaatttgatgattgtgattttacgaagaactatatcaacaaactgatagaaaaataccatagacaattgaaggaaattttcgttaatctcgatagaaacaggccaagagtgatcgcattttattattctgtggaggcttatctatatcagtataagcttgctgtatttattggagaaatgtcccatgccttgaatgaaaaatttgaattacccaaagaagtaacagaagattttgttaagtgctatcactgttgcaaatctgccctcgaggaattttcaaaattagagccaattttaataacctctttacctttattccatacgtctaggatcatctacactgtgggtatgcttttattaaaattaaggtactccgttgttgccattccttcatttaatgatctgatgccattgacagacggtgctattgcattggtgataacggtgaacaacctcttggaaaaaacatccgaactatatccgttcaataattctctttacaaatttaggtatgttatcgcattattttgccagacctatgcaaacaaggttatcgatgtcgctgatcgctacaatgcaaaaagagaagaacaaacgcaaaggcaaactgtcaacgaaacaatgcatgatcaaaaggacgtgcatccaacaaatacgcacgaaacggaaccacaaaatatggagaaagaacaggatcctatcgtcgaaaataatacccgccaaagtatatctaccgttccagatgagatgttaccagtatatttaagagttcgcgacgacactgccgccatgagctcgaatatcaatagcacttcctgctttaatgggccgccacgccaacctcaagagagcctagcaggatcaacactactgcctccaccattcatttcgaatactaacagttctaataacagcgatataactaatataaaaccatcccctagttcatcagttgataatttaaacgattatctgaccgacattaattccttagcatggggtgtgaactcattaaatgacgagttttggacagatcttttcatgaatgataattaa

SEQ ID NO: 308 - protein, 965 aa, Saccharomyces bayanus
MYSSFNSRDREGFQKESCNMNTQFSVAGLATGKESNGTLKANSKMASPRADDPLIDMTTQTIIEGCVDDDTRLLYPTKLETTENGKIKRNSFACVCCHSLKQKCVPSDANDIYRKPCQRCLKHKKVCKFDLAKRTRKRKQRSRSSTSLESPIQDVSKKGEFPVNFKESSLKNNTSYPITFPLDSNTKQVSNSRTVLPGLQQSLSDLWSTLSQPTSERVRDAESTPSEDRIVNKSTQSKGGNSISANISLLASTDERTKSSGAPVIYSSYNSPIPMPSIPTSTNSEASFKPRPNVVGDEGTYNGKAKRQKNSYSKHMTRSFRKQLQSLIISQKGKIRDISMKLDTWSKQWNDLVERSMFLPTISDPVSVGIISHEEATLRLHLYKTEISYLSKLPFIKVEENVSVDELRKRKPILFSVIMSCVSIVLTPRQTTRGTIMKLDSFVLNLITNQIFKANNKSIEIIESLSTLCLWYNFFEWSSKTRYHIFNYICCCLTRDLGPTYVNRSFGMFSDEDPDRFKSPLELYSSGSSLILLVYVSALNISIFLRQSIQARWSHVTEKACQDLIKEKRGSQQNNNDQLLPGMTDDPILVQFAKMNHVLENIHTHLHERDFNDDEFDDCDFTKNYINKLIEKYHRQLKEIFVNLDRNRPRVIAFYYSVEAYLYQYKLAVFIGEMSHALNEKFELPKEVTEDFVKCYHCCKSALEEFSKLEPILITSLPLFHTSRIIYTVGMLLLKLRYSVVAIPSFNDLMPLTDGAIALVITVNNLLEKTSELYPFNNSLYKFRYVIALFCQTYANKVIDVADRYNAKREEQTQRQTVNETMHDQKDVHPTNTHETEPQNMEKEQDPIVENNTRQSISTVPDEMLPVYLRVRDDTAAMSSNINSTSCFNGPPRQPQESLAGSTLLPPPFISNTNSSNNSDITNIKPSPSSSVDNLNDYLTDINSLAWGVNSLNDEFWTDLFMNDN

What is claimed is:

1. A recombinant microorganism comprising enzymes of an isobutanol producing metabolic pathway, wherein said recombinant microorganism is a yeast microorganism and comprises at least one exogenous gene encoding a polypeptide that catalyzes a step in the conversion of pyruvate to isobutanol, wherein said recombinant microorganism is engineered to disrupt, partially delete, or completely delete a gene encoding OPT1, and wherein said recombinant microorganism produces more isobutanol than a corresponding yeast microorganism that has not been engineered to disrupt, partially delete, or completely delete a gene encoding OPT1.

2. The recombinant microorganism of claim 1, wherein said recombinant microorganism is engineered to disrupt, partially delete, or completely delete a gene encoding pyruvate decarboxylase.

3. The recombinant microorganism of claim 1, wherein said recombinant microorganism is engineered to disrupt, partially delete, or completely delete a gene encoding glycerol-3-phosphate dehydrogenase.

4. The recombinant microorganism of claim 1, wherein said recombinant microorganism is of the *Saccharomyces* clade.

5. The recombinant microorganism of claim 4, wherein said recombinant microorganism is a *Saccharomyces sensu stricto* microorganism.

6. The recombinant microorganism of claim 5, wherein said *Saccharomyces sensu stricto* microorganism is selected from the group consisting of *S. cerevisiae, S. kudriavzevii, S. mikatae, S. bayanus, S. uvarum, S. carocanis* and hybrids thereof.

7. The recombinant microorganism of claim 1, wherein said recombinant microorganism is a Crabtree-negative yeast microorganism.

8. The recombinant microorganism of claim 7, wherein said Crabtree-negative yeast microorganism is classified into a genus selected from a group consisting of *Saccharomyces, Kluyveromyces, Pichia, Hansenula, Issatchenkia* and *Candida*.

9. The recombinant microorganism of claim 8, wherein said Crabtree-negative yeast microorganism is selected from the group consisting of *Saccharomyces kluyveri, Kluyveromyces lactis, Kluyveromyces marxianus, Pichia anomala, Pichia stipitis, Pichia kudriavzevii, Issatchenkia orientalis, Hansenula anomala, Candida utilis* and *Kluyveromyces waltii*.

10. The recombinant microorganism of claim 1, wherein said recombinant microorganism is a Crabtree-positive yeast microorganism.

11. The recombinant microorganism of claim 10, wherein said Crabtree-positive yeast microorganism is classified into a genus selected from a group consisting of *Saccharomyces, Kluyveromyces, Zygosaccharomyces, Debaryomyces, Pichia, Candida*, and *Schizosaccharomyces*.

12. The recombinant microorganism of claim 11, wherein said Crabtree-positive yeast microorganism is selected from the group consisting of *Saccharomyces cerevisiae, Saccharomyces uvarum, Saccharomyces bayanus, Saccharomyces paradoxus, Saccharomyces castelli, Kluyveromyces thermotolerans, Candida glabrata, Zygosaccharomyces bailli, Zygosaccharomyces rouxii, Debaryomyces hansenii, Pichia pastorius, Schizosaccharomyces pombe*, and *Saccharomyces uvarum*.

13. The recombinant microorganism of claim 1, wherein said recombinant microorganism is a post-WGD (whole genome duplication) yeast microorganism.

14. The recombinant microorganism of claim 13, wherein said post-WGD yeast microorganism is classified into a genus selected from a group consisting of *Saccharomyces* or *Candida*.

15. The recombinant microorganism of claim 14, wherein said post-WGD yeast microorganism is selected from the group consisting of *Saccharomyces cerevisiae, Saccharomyces uvarum, Saccharomyces bayanus, Saccharomyces paradoxus, Saccharomyces castelli*, and *Candida glabrata*.

16. The recombinant microorganism of claim 1, wherein said recombinant microorganism is a pre-WGD (whole genome duplication) yeast microorganism.

17. The recombinant microorganism of claim 16, wherein said pre-WGD yeast microorganism is classified into a genus selected from a group consisting of *Saccharomyces, Kluyveromyces, Candida, Pichia, Debaryomyces, Hansenula, Issatchenkia, Pachysolen, Yarrowia* and *Schizosaccharomyces*.

18. The recombinant microorganism of claim 17, wherein said pre-WGD yeast microorganism is selected from the group consisting of *Saccharomyces kluyveri, Kluyveromyces thermotolerans, Kluyveromyces marxianus, Kluyveromyces waltii, Kluyveromyces lactis, Candida tropicalis, Pichia pastoris, Pichia anomala, Pichia stipitis, Pichia kudriavzevii, Issatchenkia orientalis, Debaryomyces hansenii, Hansenula anomala, Pachysolen tannophilis, Yarrowia lipolytica*, and *Schizosaccharomyces pombe*.

19. A method of producing isobutanol, comprising:

(a) providing a recombinant microorganism of claim 1;

(b) cultivating the recombinant microorganism in a culture medium containing a feedstock providing the carbon source, until a recoverable quantity of isobutanol is produced.

* * * * *